(12) United States Patent
Wu

(10) Patent No.: US 11,028,138 B2
(45) Date of Patent: Jun. 8, 2021

(54) COMPOSITIONS AND METHODS FOR USING ACTIN-BASED PEPTIDES TO MODULATE CELLULAR BIOACTIVITY AND CELLULAR SUSCEPTIBILITY TO INTRACELLULAR PATHOGENS

(71) Applicant: Virongy L.L.C., Manassas, VA (US)

(72) Inventor: Yuntao Wu, Manassas, VA (US)

( * ) Notice: Subject to any disclaimer, the term of this patent is extended or adjusted under 35 U.S.C. 154(b) by 0 days.

(21) Appl. No.: 15/446,240

(22) Filed: Mar. 1, 2017

(65) Prior Publication Data

US 2018/0002390 A1    Jan. 4, 2018

Related U.S. Application Data

(60) Provisional application No. 62/357,991, filed on Jul. 2, 2016.

(51) Int. Cl.
| | | |
|---|---|---|
| *C07K 14/47* | (2006.01) |
| *A61K 47/64* | (2017.01) |
| *A61K 47/51* | (2017.01) |
| *A61K 38/17* | (2006.01) |
| *A61K 38/00* | (2006.01) |

(52) U.S. Cl.
CPC ...... *C07K 14/4716* (2013.01); *A61K 38/1719* (2013.01); *A61K 47/51* (2017.08); *A61K 47/64* (2017.08); *A61K 38/00* (2013.01); *C07K 2319/10* (2013.01)

(58) Field of Classification Search
CPC .............................. C07K 14/4716; A61K 47/64
See application file for complete search history.

(56) References Cited

U.S. PATENT DOCUMENTS

| | | | | |
|---|---|---|---|---|
| 6,087,398 A * | 7/2000 | Goodman | ............ | A61K 31/095 514/562 |
| 7,018,791 B1 * | 3/2006 | Willison | ................ | C07H 21/00 435/4 |
| 7,973,134 B2 * | 7/2011 | Moritz | .................... | C07K 16/44 530/387.1 |
| 9,598,474 B2 * | 3/2017 | Berry | .................... | C07K 14/435 |
| 2004/0031072 A1 * | 2/2004 | La Rosa | ................ | C07H 21/04 800/278 |
| 2005/0112118 A1 * | 5/2005 | Cimbora | ................ | C07K 14/47 424/143.1 |
| 2007/0015271 A1 * | 1/2007 | Rosen | .................... | C07K 14/47 435/252.1 |
| 2007/0072235 A1 * | 3/2007 | Moritz | ............... | G01N 33/6842 435/7.1 |
| 2009/0325189 A1 * | 12/2009 | Hornbeck | .............. | C07K 16/44 435/7.1 |
| 2011/0136137 A1 | 6/2011 | Borlak et al. | | |
| 2012/0322073 A1 * | 12/2012 | Lopez-Girona | ............................ | G01N 33/57484 435/6.12 |
| 2015/0011482 A1 * | 1/2015 | Berry | .................... | C07K 14/435 514/21.2 |
| 2015/0224167 A1 * | 8/2015 | Choi | ....................... | A61K 38/10 514/1.2 |
| 2016/0146786 A1 | 5/2016 | Hopkins et al. | | |

FOREIGN PATENT DOCUMENTS

WO       WO 98/53322       * 11/1998       ............. G01N 33/68

OTHER PUBLICATIONS

International Search Report and Written Opinion for PCT/US17/40415, dated Dec. 11, 2017.

* cited by examiner

*Primary Examiner* — Amber D Steele
(74) *Attorney, Agent, or Firm* — Piloff Passino & Cosenza LLP; Sean A. Passino; Rachel K. Piloff

(57) ABSTRACT

Compositions and methods for using actin-based peptides to modulate cellular bioactivity, including modulation of cellular susceptibility to intracellular pathogens, such as bacteria and viruses.

15 Claims, 8 Drawing Sheets

Specification includes a Sequence Listing.

Fig. 1

A  Human β-actin  L = 375
N|————————————————————|C
 1                    375

Overlapping peptide library

N1
   B1
      Actin core domain

B  N [====]C
     Cell penetration domain
     Spacer domain
or
   N[====]C

Schematic of the actin-based Peptide

C  Screening of the Actin-based Peptide Library for Bioactivity in enhancing HIV Infection (bar chart: Relative HIV replication, 0%–450%, x-axis: HIV only, +N1, +N2, +N3, +N4, +N5, +N6, +N7, +N8, +N9, +N10, +N11, +N12, +N13, +N14, +N15, +N16, +N17, +N18, +N19, +N20)

HIV + actin-based peptide

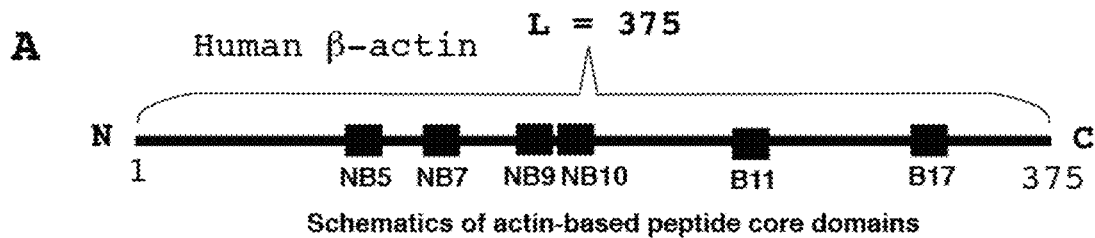

Schematics of actin-based peptide core domains

B

| Core Domain Name | Amino Acid Sequence | |
|---|---|---|
| NB5: | YNELRVAPEE | SEQ ID NO: 853 |
| NB7: | QIMFETFNTP | SEQ ID NO: 854 |
| NB9: | LPHAILRLDL | SEQ ID NO: 855 |
| NB10: | AGRDLTDYLM | SEQ ID NO: 856 |
| B11: | LCYVALDFEQ | SEQ ID NO: 857 |
| B17: | KYSVWIGGSI | SEQ ID NO: 858 |

C

```
            10          20          30          40          50          60
    MDDDIAALVV  DNGSGMCKAG  FAGDDAPRAV  FPSIVGRPRH  QGVMVGMGQK  DSYVGDEAQS
            70          80          90   NB5    100         110         120
    KRGILTLKYP  IEHGIVTNWD  DMEKIWHHTF  YNELRVAPEE  HPVLLTEAPL  NPKANREKMT
    NB7    130         140         150         160         170   NB9    180
    QIMFETFNTP  AMYVAIQAVL  SLYASGRTTG  IVMDSGDGVT  HTVPIYEGYA  LPHAILRLDL
    NB10   190         200         210         220   NB11   230         240
    AGRDLTDYLM  KILTERGYSF  TTTAEREIVR  DIKEKLCYVA  LDFEQEMATA  ASSSSLEKSY
           250         260         270         280         290         300
    ELPDGQVITI  GNERFRCPEA  LFQPSFLGME  SCGIHETTFN  SIMKCDVDIR  KDLYANTVLS
           310         320         330         340   NB17   350         360
    GGTTMYPGIA  DRMQKEITAL  APSTMKIKII  APPERKYSVW  IGGSILASLS  TFQQMWISKQ
           370
    EYDESGPSIV  HRKCF                                          SEQ ID NO: 848
```

D

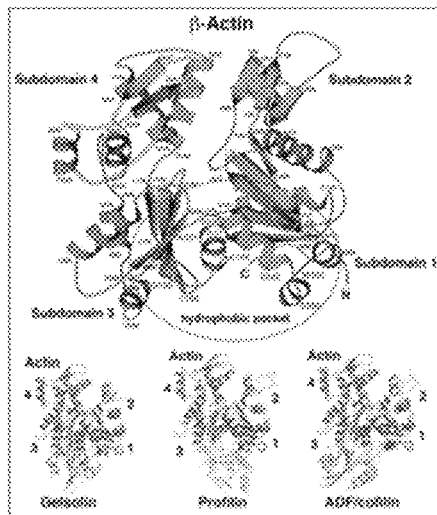

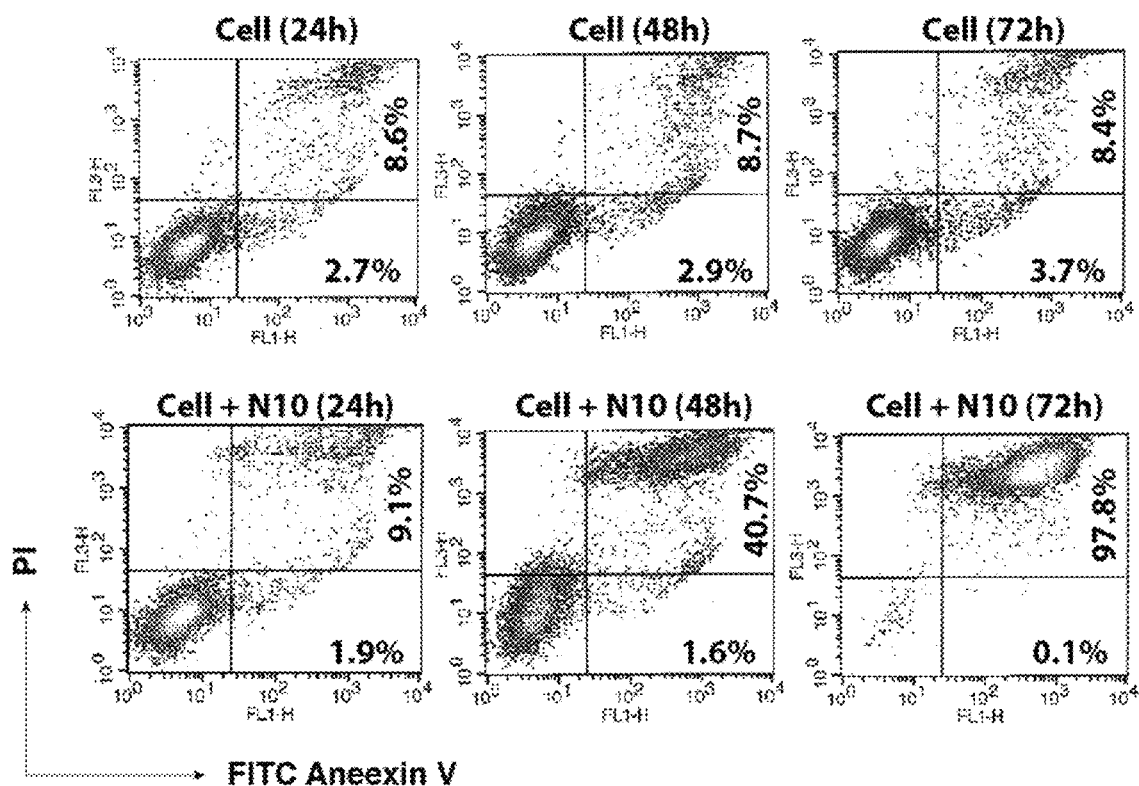

COMPOSITIONS AND METHODS FOR USING ACTIN-BASED PEPTIDES TO MODULATE CELLULAR BIOACTIVITY AND CELLULAR SUSCEPTIBILITY TO INTRACELLULAR PATHOGENS

CROSS-REFERENCE TO RELATED APPLICATION

This application claims priority to U.S. Provisional Application No. 62/357,991, filed Jul. 2, 2016, which application is incorporated by reference herein in its entirety.

FIELD

The present disclosure relates to modulating cellular bioactivity and cell susceptibility to viral infection through modulating actin dynamics. Provided herein are methodology, compositions, and the like for modulating actin-related cellular bioactivity and cellular susceptibility to viral infection.

INTRODUCTION

Actin-Related Cellular Bioactivity:

The cytoskeleton of a cell consists of three main filaments: actin filaments (also called microfilaments), intermediate filaments, and microtubules. The cytoskeleton provides a cell with shape, structure, and an anchorage for various organelles. It also provides driving forces for cell migration and intracellular transport of macromolecules. In addition, actin regulates many key functions in cells, including:

The formation of various of actin networks in cells for providing cellular trafficking routes.
Modulation of cell surface receptors. Actin is heavily involved in receptor clustering and cycling.
Cytokinesis. Cell division involves a constricting ring that is composed of actin, myosin, and a-actinin.
Apoptosis. Actin is degraded into two fragments during apoptosis. Stress can induces the formation of stress fibers that is involved in apoptosis. The mitochondrial migration of the actin binding protein cofilin is also involved in triggering cell apoptosis.
Cell adhesion and development. Adhesion of epithelial cells with extracellular matrix or with adjacent cells involves the actin cytoskeleton as well as cadherins and catenins.
Gene expression modulation. Actin's state of polymerization can affect the pattern of gene expression.
Smooth and hear muscle contraction: both actin and myosin are involved in muscle contraction and relaxation, and they make up 90% of muscle protein. The interaction of actin-myosin results in the movement of the two proteins that produces contractions.
Nuclear actin function: actin can also enter the nucleus, and is involved in the architectural integrity of the nucleus, gene transcription, and translocation of the activated chromosome fragment from under membrane to euchromatin.

Actin Filaments:

The major cytoskeletal protein of cells is actin, a 43-kd protein that polymerizes to form actin filaments—thin, flexible fibers approximately 7 nm in diameter and up to several micrometers in length. Within the cell, actin filaments are organized into higher-order structures, forming bundles or three-dimensional networks with the properties of semisolid gels. The assembly and disassembly of actin filaments, their crosslinking into bundles and networks, and their association with other cell structures such as the plasma membrane are regulated by a variety of actin-binding proteins which are critical components of the actin cytoskeleton. Actin filaments are particularly abundant beneath the plasma membrane, where they form a network that provides mechanical support, determines cell shape, and allows movement of the cell surface, thereby enabling cells to migrate, engulf particles, and divide. Cooper, G. M., *The Cell: A Molecular Approach*, $2^{nd}$ Ed., Sinauer Associates, Sunderland, Mass. (2000). ncbi.nlm.nih.gov Actin structure, function and sequences are described by Otterbein, L R, The Crystal Structure of Uncomplexed Actin in the ADP State, *Science, Vol.* 293, 27 Jul. 2001; Kabsch, W., The Actin Fold, *FASEB J.* 9, 167-174 (1995); Homes, K. C. et al., Atomic model of the actin filament, *Nature, Vol.* 347, 6 Sep. 1990; Mattila, P. K. et al., Dynamics of the actin cytoskeleton mediates receptor cross talk: An emerging concept in tuning receptor signaling, *J. Cell Biol. Vol.* 212 No. 3, 267-280 (2016); Sandiford, S. L. et al. (2015), Cytoplasmic Actin Is an Extracellular Insect, *PLoS Pathog* 11(2): e1004631. doi:10.1371/journal.ppat. 1004631; Hardin, J., Regulating cell-cell junctions from A to Z, *J. Cell Biol. Vol.* 213 No. 2 151-153 (2016); and Yoder, A. et al., HIV Envelope-CXCR4 Signaling Activates Cofilin to Overcome Cortical Actin Restriction in Resting CD4 T Cells, *Cell* 134, 782-792, Sep. 5, 2008.

There are three actin isoforms, alpha, beta, and gamma. Alpha actin is mainly found in contractile structures such as those of muscle cells. Beta actin is found at the leading edge of migrating cells to drive cell mobility. Gamma actin is found in the filaments of stress fibers. Actins exist either as a monomeric form (G-actin) or as assembled, double helical, filamentous polymers (filamentous actin, F-actin, or microfilaments).

In cells, the actin cytoskeleton provides mechanical support and is a major driving force for cell motility. Actin also participates in many cellular processes such as cell division, surface receptor cycling, vesicle and organelle movement, and signal transduction. In immune cells, actin is also involved in cell adhesion, cell migration, chemotaxis, and T cell activation (Wulfing and Davis, 1998).

Intracellular actin activity is regulated through actin polymerization and depolymerization, which are regulated by multiple actin modulators in cells. In test tubes, in the absence of other actin regulators, G-actin can automatically polymerize at high salt concentration. Polymerized actin filaments (F-actin) can also dissociate into G-actin. Structurally, polymerized actin filaments have polarity, with (+) and (−) ends (or barbed and pointed ends). When actin polymerization and depolymerization reactions reach a steady-state, G-actin is added to the (+) end and dissociated from the (−) end at equal rates, so the length of the actin filaments remains constant. This process is called actin treadmilling, which resembles a process of actin subunits "walking" from the (+) end to the (−) end (Pollard and Borisy, 2003).

In cells, actin dynamics are tightly regulated to ensure proper and speedy response to stimuli. G-actin is normally associated with cellular regulators such as profilin and thymosin (34. Profilin acts as a nucleotide-exchange factor, which allows the switch from ADP-actin to ATP-actin ready for actin polymerization. Thymosin (34 is an actin-sequestering protein, which serves as a buffering protein for the maintenance of the monomeric actin pool. F-actin is also associated with multiple cellular regulators such as ADF/ cofilin and the Apr2/3 complex. ADF/Cofilin is a family of actin-severing proteins which depolymerize F-actin mainly at the (−) end. The Arp2/3 complex is a seven-subunit protein that promotes the growth of new actin filaments. In addition, actin capping proteins such as CapZ and gelsolin can cap the ends of actin filaments, preventing actin polymerization or depolymerization (Pollard and Borisy, 2003).

In cells, actin and microtubule cytoskeleton gives mechanical support and control of cell shape. The actin and microtubule cytoskeleton networks also provide trafficking routes through cytoplasm for intracellular macromolecules and, sometimes, invading bacteria and viruses. In non-muscle cells, actin polymerization and depolymerization provide a major driving force for cell migration through treadmilling, whereas in muscle cells, actin fiber is the scaffold on which myosin proteins generate force to produce muscle contraction. In addition, actin has a wide range of roles, including regulation of cell surface receptors, cell division, cell adhesion and differentiation, T cell/B cell activation, and gene expression.

Actin is also involved in the process of apoptosis, in which cellular stress induces the reorganization of the actin cytoskeleton, giving rise to actin stress fiber. During apoptosis, actin is fragmented into two fragments of 15 kD and 31 kD by the ICE/ced-3 family of proteases, which is one of the major characteristics of apoptotic cells.

The microtubule network also plays important roles in many cellular processes. Microtubules provide means of intracellular transport of organelles and secretory vesicles. They are also involved in the formation of mitotic spindles during cell division (mitosis and meiosis). Drugs targeting microtubules are known to induce apoptosis of cancer cells.

Actin and microtubule dynamics are also important for intracellular bacterial and viral infection of cells. Actin polymerization and depolymerization can modulate receptor dynamics, facilitating the entry of bacteria and viruses. Actin polymerization can produce essential driving forces and scaffolds for bacterial and viral intracellular migration, nucleic acid synthesis and transcription, or virion assembly and budding (Spear et al. 2012; Spear et al. 2013; Taylor et al 2011). The microtubule network is frequently used by intracellular bacteria and viruses for migrations inside and between cells (Kotsakis et al. 2001).

In general, the actin-derived peptides of the invention are modified in order to penetrate cells, e.g., by addition of an N-terminal polyarginine segment. Relevant reviews of cell-penetrating peptides are: C. Bechara et al., Cell-penetrating peptides: 20 years later, where do we stand?, *FEBS Letters* 587 (2013) 1693-1702; B. Gupta, et al., Intracellular delivery of large molecules and small particles by cell-penetrating proteins and peptides, *Advanced Drug Delivery Reviews* 57 (2005) 637-651; M. Lindgren, et al., cell-penetrating peptides, *TIPS*—March 2000 (Vol. 21) 99-103; M. Kristensen, et al., Applications and Challenges for Use of Cell-Penetrating Peptides as Delivery Vectors for Peptide and Protein Cargos, *Int. J. Mol. Sci.* 2016, 17, 185; and F. Milletti, Cell-penetrating peptides: classes, origin, and current landscape, *Drug Discovery Today, Vol.* 17, No 15-16, August 2012.

Actin is involved in: 1) supporting cell shape and cell growth; 2) driving cells to migrate; 3) cell signal transduction; 4) cell surface receptor cycling between the surface and the cytoplasm; 5) cell-cell junction and cell adhesion; 6) muscle cell contraction; 7) in the cardiovascular system, actin activity affects heart beat and blood vessel elasticity and capacitance; 8) the process of viral and bacterial infection. Actin can function as a barrier to block viral infection, while viruses and bacteria may also use actin polymerization to promote inter- and intracellular migration; 9) the intracellular delivery of chemical compounds (e.g. small-molecule drugs) and biological substances (e.g. DNA, peptides, and proteins et al). The cortical actin in a cell structure can also block the intracellular delivery of compounds and substances, affecting the delivery efficiency; 10) the process of cell growth, differentiation and apoptosis.

The crystal structure of G-actin coupled with DNase I was solved in 1990 by Kabsch and colleagues [5]. The crystal structure of uncomplexed actin was also solved by Otterbein and coauthors [2]. The near-atomic resolution structure of F-actin was deduced by Holmes and colleagues using a combination of the crystal structure of G-actin and X-ray fiber diffraction data [3]. Currently, there are also over 80 structures of actin in complex with various actin binding proteins such as gelsolin, cofilin, and profilin [4]. Structurally, actin is organized into two related domains, which can be further subdivided into 4 subdomains numbered 1 to 4 (FIG. 2D).

β-actin structure, showing subdomains 1 to 4 and the hydrophobic cleft between subdomains 1 and 3 (red circle). This hydrophobic cleft is a common binding pocket of most actin binding proteins (ABPs) such as gelsolin, profilin, and ADF/cofilin as shown. Two diametrically opposed clefts separate the two large domains of actin. The larger cleft, between subdomains 2 and 4, constitutes the nucleotide-binding site, whereas the smaller cleft, between subdomains 1 and 3, mediates the interactions of actin with most actin binding proteins (ABPs) (FIG. 2D). ABPs are extremely diverse, both structurally and functionally, but for some reason related to the filament structure, most ABPs seem to share a common binding area on the actin surface, which is the hydrophobic pocket between actin subdomains 1 and 3. Both gelsolin and cofilin bind to this cleft, and profilin also interacts with the back of this cleft. It is possible that our peptides interface with the binding of some ABPs, thereby disturbing actin dynamics, and indirectly the dynamics of surface receptors.

SUMMARY

In one aspect, provided is an actin-based peptide, comprising an actin core domain and a cell penetration domain, operably linked together by a spacer domain, wherein an N-terminus or C-terminus may have either the actin core domain or the cell penetration domain.

In one embodiment, the actin core domain is selected from the group consisting of NB5 (SEQ ID NO: 1, 7, 15-138), NB7 (SEQ ID NO: 2, 8, 9, 139-290), NB9 (SEQ ID NO: 3, 9, 10, 11, 291-470), NB10 (SEQ ID NO: 4, 12, 471-601), B11 (SEQ ID NO: 5, 13, 602-723), and B17 (SEQ ID NO: 6, 14, 724-845).

In another embodiment, the actin core domain is labeled with a traceable dye or marker.

In another aspect, provided is an actin-based peptide, comprising a B11 core selected from the sequences set forth in SEQ ID NO: 5, 13, and 602-723.

In another aspect, provided is a method for controlling viral or bacterial infection, comprising administering an actin-based peptide to a cell, virus, or bacteria, in an amount sufficient to inhibit or enhance infection of said virus or bacteria. In one embodiment, HIV infection is increased by administering said actin-based peptide to a cell. In another embodiment, the actin-based peptide comprises an actin core domain selected from NB7 (SEQ ID NO: 2, 8, 9, 139-290), and NB9 (SEQ ID NO: 3, 9, 10, 11, 291-470).

In another aspect, provided is a method for inhibiting or enhancing viral or bacterial infection, comprising: administering an agent to a cell or a virus or bacteria, with an amount of one or more peptide sequences selected from SEQ ID NOs: 1-845 effective to inhibit or enhance infection of said virus or bacteria.

In another aspect, provided is a method for inhibiting or enhancing viral or bacterial vector delivery into a cell, comprising: administering an agent to a cell or a viral or bacterial vector, with an amount of one or more peptide sequences selected from SEQ ID NOs: 1-845 effective to inhibit or enhance vector delivery to said virus or bacteria.

In another aspect, provided is a method for modulating actin dynamics in a cell, comprising: delivering into a cell one or more actin peptides selected from SEQ ID NOs: 1-845, in an amount effective to modulate actin dynamics.

In another aspect, provided is a method for modulating cellular bioactivity, comprising: delivering into a cell one or more actin-based peptides selected from SEQ ID NOs: 1-845, in an amount effective to modulate cellular bioactivity. In one embodiment, the cellular bioactivity is: cytoplasmic and nuclear actin dynamics, cell morphology, cell motility and mobility, cell surface receptor density, cell adhesion processes, gene expression, cell division, growth, differentiation, and apoptosis, the processes of endocytosis and exocytosis, smooth and heart muscle cell contraction and relaxation, blood vessel elasticity and capacitance, a process of inflammation, cellular susceptibility to intracellular pathogens, or cellular uptake of chemical compounds, including small and macro molecules, medical drugs, nucleic acids, and proteins.

In another embodiment, provided is an actin-based peptide conjugated to a cell-penetration peptide or membrane-permeable molecule. In one embodiment, the peptide fragment is selected from SEQ ID NO: 1-845. In another embodiment, the peptide fragment is labeled with a traceable dye or marker.

In another aspect, provided is a method of making a peptide composition, comprising:
a) synthesizing one or more actin-based peptides; and
b) covalently conjugating or non-covalently conjugating said actin-based peptide with a traceable dye, a small molecule, nucleic acid, peptide, or protein.

In another aspect, provided is a method of making a peptide composition, comprising:
a) synthesizing one or more actin-based peptides selected from SEQ ID NOs: 1-845; and
b) covalently conjugating or non-covalently conjugating said actin-based peptide with a traceable dye, a small molecule, nucleic acid, peptide, or protein.

In another aspect, provided is a method for intracellular delivery of an actin peptide fragment, comprising: conjugating said actin peptide fragment with a cell-penetration peptide or membrane-permeable molecule.

In another aspect, provided is a peptide having a formula set forth in SEQ ID NOs: 1-845. In one embodiment, the peptide is a cyclic peptide.

In another aspect, provide is a kit comprising one or more peptides having a formula set forth in SEQ ID NOs: 1-845, and an effective amount of a therapeutic compound, a diagnostic compound, or a compound for modulating cellular activity.

Objects of the instant actin-derived peptides:
1) To enhance or inhibit cell signal transduction; enhance or block the activation of signaling pathways related to regulating actin dynamics.

2) To up-regulate or down-regulate receptor density on the cell surface such as up-regulate the chemokine receptors, adhesion molecules, cancer related surface receptors on the cell surface.

3) To enhance or inhibit viral infection or viral vector transduction of cells; promote or inhibit viral spreading.

4) To affect the process of cell growth, differentiation and apoptosis.

Other objects include providing compositions and methods for enhancing or inhibiting viral infections. In one embodiment, actin-based peptide can be used to trigger actin dynamics to modulate pathogen infection.

Another object is to provide actin-based peptides which can be used to enhance viral vector entry into cells such as cancer cells, stem cells, or terminally-differentiated cells for gene delivery or gene therapy.

In another aspect, the actin-based peptides can be used to enhance viral amplification in primary culture of cells from biological samples, such as blood samples or tissue samples. The use of these peptides can facilitate the isolation and recovery of viruses from biological samples such as the recovery of HIV from blood CD4 T cells.

In another aspect, because modulating actin and cofilin activity can lead to apoptosis, the subject peptides can be used to trigger cell death for therapy, such as killing cancer cells.

Another object is to provide peptides and methods of modulating actin activity, to either inhibit or enhance cell migration and cell mobility. Such peptides can be used to inhibit or enhance cell migration in the body. They can be used to slow down cancer cell migration, or used as anti-inflammatory drugs, or used to modulate the movement of stem cells in the body, or used to attract progenitor cells for tissue damage repairs.

In another aspect, actin-based peptides can be used to up-regulate or down-regulate cell surface receptors, change cellular behaviors or responses to receptor-mediated signal transduction. This property can be used to facilitate the study of receptor dynamics and cell signaling, or to facilitate the efficacy of medical drugs targeting cell receptors and signaling pathways.

In another aspect, actin-based peptides can be labeled with a traceable dye or marker and be used to monitor intracellular actin and microtubule dynamics, and the behaviors of actin-binding proteins.

BRIEF DESCRIPTION OF THE DRAWINGS

FIG. 1: (A) Schematic representation of the design and discovery of the actin-based peptides. The whole amino acid (AA) sequence of β-actin (L=375 AA) can be divided into a library of overlapping peptides with defined amino acid length (e.g. 10 to 40 AA), which is defined as the actin core domain. The actin-based peptides also contain an additional domain which allows them to penetrate cell membrane to enter cells. In addition, the actin-based peptides also contain a spacer domain which links the actin core domain with the cell penetration domain. (B) Screening of an actin-based peptide library for bioactivities in enhancing HIV infection. An HIV reporter T cells, Rev-CEM-GFP, were treated with each actin-based peptide, and then infected with HIV-1. Enhancement of HIV infection was quantified. For controls, HIV replication in peptide-untreated cells was quantified, and plotted as 100%. In this screening, peptide N5, N7, and N9 were found to enhance HIV replication from 350% to 400%.

FIG. 2: (A) Schematic representation of the actin-core domains discovered from screening. (B) The amino acid sequences of the core domains. (C) The location and AA position of the actin-core domains within the human β-actin protein (SEQ ID NO: 848). (D) β-actin structure, showing subdomains 1 to 4 and the hydrophobic cleft between subdomains 1 and 3 (red circle). This hydrophobic cleft is a common binding pocket of most actin binding proteins (ABPs) such as gelsolin, profilin, and ADF/cofilin as shown.

FIG. 8: Human T lymphoblast cell A3.01 was treated with N10 (10 uM). N10-mediated cell killing was monitored by staining of dead cells with Propidium iodide and FITC-labelled Annexin V. Cells were analyzed by flow cytometry.

DETAILED DESCRIPTION

Figure 3:
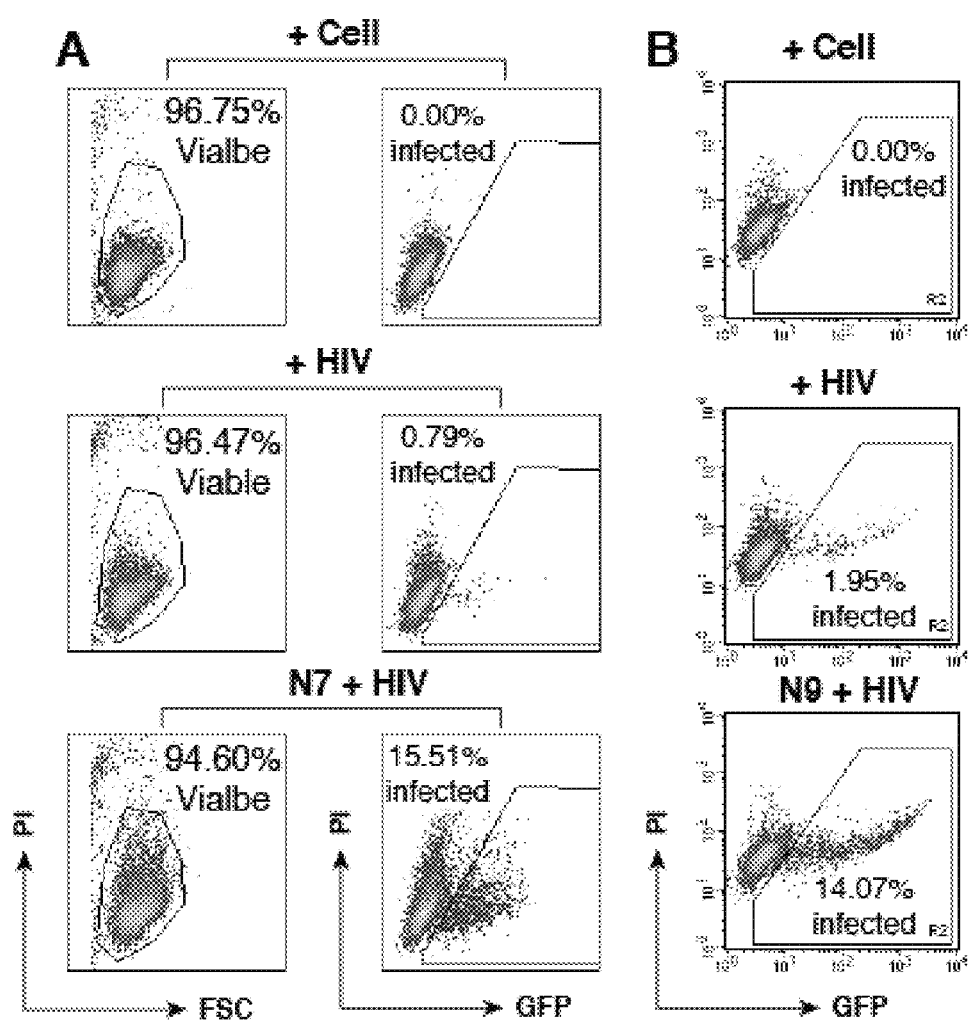
FIG. 3: Enhancement of HIV infection by actin-based peptides N7 and N9. (A) The HIV Rev-dependent indicator cell, Rev-CEM-GFP, was not infected (+Cell) or infected with HIV-1 (+HIV), or pre-treated with peptide N7, and then infected with HIV-1 (N7+HIV). Following infection for 2 hours, cells were washed to remove the virus and the peptide. Viral replication was measured at 2 days post infection by flow cytometry. N7 enhances HIV infection from 0.79% to 15.5%, as measured by the percentage of GFP+ cells. PI, propidium iodide, was added before flow cytometry for cytotoxicity control. GFP+ cells were counted only when the cells are viable (low PI staining). (B) Effects of peptide N9 were similarly measured. It enhanced HIV infection from 1.95% to 14.07%
Figure 4:
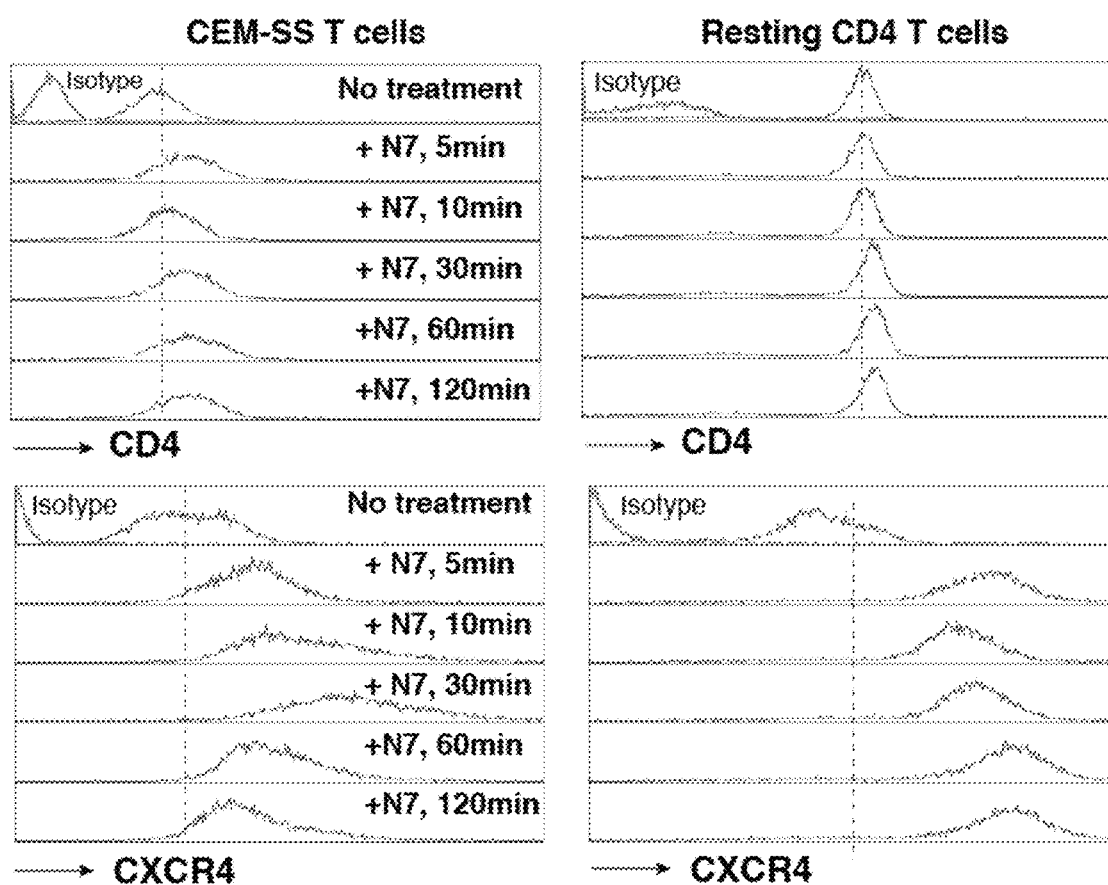
FIG. 4: Up-regulation of cell surface receptors by N7. CEM-SS T cells or blood resting CD4 T cells were stimulated with peptide N7 for a time course. Effects on surface CD4, CXCR4 density were measured by anti-CD4 or anti-CXCR4, followed by flow cytometry.

The present disclosure relates to composition and methodology for using actin-based peptide fragments to modulate cellular bioactivity, including but not limited to modulating cytoplasmic and nuclear actin dynamics, cell morphology, modulating cell motility and mobility, cell receptor dynamics, cell adhesion processes, gene expression, cell division, growth, differentiation, and apoptosis, the processes of endocytosis and exocytosis, the process of inflammation, and cellular susceptibility to intracellular pathogens such as viruses.

In one embodiment, and as described below, actin dynamics can be modulated by using actin-based peptides that are delivered intra-cellularly. These actin-based peptides, either in the L- or D-forms, can trigger or modulate actin dynamics, which lead to the modulation of cellular bioactivity such as modulation of cell surface receptors, inhibiting or promoting cell migration, increasing or decreasing cell death, or altering cellular susceptibility to intracellular bacterial or viral pathogens.

The intracellular delivery of actin-based peptides can be achieved through conjugation with cell-penetration peptide (CPPs) or membrane-permeable molecule. Currently, there are many documented CPPs that are derived from various sources (e. g. Milletti F. Cell-penetrating peptides: classes, origin, and current landscape. Drug Discovery Today, Vol. 17, Numbers 15/16, August 2012:). CPPs are groups of diverse peptides around 5-30 amino acids. CPPs can cross the cellular membrane and act as vehicles for the intracellular delivery of proteins, peptides, small molecules, and nucleic acids. Currently, CPPs can be classified into 3 major classes: cationic, amphipathic, and hydrophobic (Table 1-3, Milletti F. Drug Discovery Today, Vol. 17, Numbers 15/16, August 2012). Cationic CPPs are mostly derived from heparin-, RNA-, and DNA-binding proteins, such as the HIV Tat peptide, arginine-based peptides, FHV coat peptide, Yeast PrP6, Penetratin, HoxA-13, PDX-1 et al. Many amphipathic CPPs are derived from antimicrobial peptides, such as LL-37, L-2, Crotamine, Buforin2, or from viral proteins, such as Ribotoxin 2 L3 loop, PreS2-TLM, VP22 et al. Many amphipathic CPPs are also derived from signal peptides [e.g. K-FGF+NLS, MPrPp(1-30)], or various natural proteins (pVEC, Azurin p18, hT18-32). There are only a few hydrophobic CPPs, compared with cathion and amphipathic peptides. Some of the hydrophobic CPPs are derived from signal peptide, such as K-FGF, or from various nature proteins, such as Bip, C105Y, FGF12 et al.

All technical terms in this description are commonly used in biochemistry, molecular biology and immunology, respectively, and can be understood by those skilled in the field of this invention. Those technical terms can be found in: MOLECULAR CLONING: A LABORATORY MANUAL, 3rd ed., vol. 1-3, ed. Sambrook and Russel, Cold Spring Harbor Laboratory Press, Cold Spring Harbor, N.Y., 2001; CURRENT PROTOCOLS IN MOLECULAR BIOLOGY, ed. Ausubel et al., Greene Publishing Associates and WileyInterscience, New York, 1988 (with periodic updates); SHORT PROTOCOLS IN MOLECULAR BIOLOGY: A COMPENDIUM OF METHODS FROM CURRENT PROTOCOLS IN MOLECULAR BIOLOGY, 5.sup.th ed., vol. 1-2, ed. Ausubel et al., John Wiley & Sons, Inc., 2002; GENOME ANALYSIS: A LABORATORY MANUAL, vol. 1-2, ed. Green et al., Cold Spring Harbor Laboratory Press, Cold Spring Harbor, N.Y., 1997; CELLULAR AND MOLECULAR IMMUNOLOGY, 4.sup.th ed. Abbas et al., WB Saunders, 1994.

As used herein, an actin-based peptide comprises an actin core domain and a cell penetration domain, operably linked together by a spacer domain. Unless indicated otherwise, the actin-based peptide N-terminus or C-terminus may have either the actin core domain or the cell penetration domain. Exemplary actin-based peptides include but are not limited to the peptides set forth in SEQ ID NOs: 1-845.

Actin core domain refers to a highly conserved domain from the actin protein sequences of human, mouse, rabbit, fly, etc. Exemplary actin core domains include NB5 (YNELRVAPEE) SEQ ID NO: 853, NB7 (QIMFETFNTP) SEQ ID NO: 854, NB9 (LPHAILRLDL) SEQ ID NO: 855, NB10 (AGRDLTDYLM) SEQ ID NO: 856, B11 (LCYVALDFEQ) SEQ ID NO: 857, and B17 (KYSVWIGGSI) SEQ ID NO: 858. Using these core domains, the present inventor developed the instant actin-based peptides set forth in SEQ ID NOs 1-845.

Cell penetration domain derive from cell-penetration peptide (CPPs) or membrane-permeable molecules.

Spacer domain refers to an amino acid sequence that links an actin core domain to a cell penetration domain. Exemplary spacer domain sequences include but are not limited to poly glycine or poly alanine.

As contemplated herein, a composition can be delivered into a cell in any form by any effective route, including but not limited to oral, parenteral, enteral, intraperitoneal, topical, transdermal (e.g., using any standard patch), ophthalmic, nasally, local, non-oral, such as aerosol, spray, inhalation, percutaneous (epidermal), subcutaneous, intravenous, intramuscular, buccal, sublingual, rectal, vaginal, intra-arterial, mucosal, and intrathecal. A composition can be administered alone, or in combination with any ingredient(s), active or inactive.

Without being bound by theory, it is thought that the actin-based peptides of the invention are likely to act through three different mechanisms: 1) the peptides disturb actin polymerization and actin depolymerization at the plus and minus ends. Thus, disturbing the process of actin treadmilling; 2) these peptides may compete directly with actin binding proteins such as cofilin, Arp2/3, thus, affecting actin dynamics; 3) these peptides may compete with actin binding adaptor proteins or actin binding motifs present on the intracellular domains of receptors.

Actin-peptides can inhibit or enhance viral infection processes at multiple steps, such as: 1) enhance or inhibit of viral entry; 2) enhance or inhibit viral intracellular migration, 3) enhance or inhibit viral nuclear migration, 4) enhance or inhibit viral assembly and budding; 5) enhance or inhibit viral cell-cell transmission.

Interaction of Viruses with Actin Cytoskeleton:

The actin cytoskeleton exists as a polarized array of filaments, termed F-actin, in dynamic equilibrium with a globular actin, or G-actin, pool. Polymerization of the F-actin filament occurs predominately at the barbed end (also known as the plus end), while depolymerization occurs predominantly at the pointed end (also known as the minus end). The precise spatiotemporal regulation of actin polymerization, mediated by actin-binding proteins (ABPs) and their upstream regulators, coordinates the force-generating and scaffolding properties of actin. These, in turn, regulate complex cellular processes including chemotaxis, cell adhesion, cytokinesis, the formation of cellular processes (microvilli, filopodia, lamellipodia, invadopodia, etc.), organelle movement, endocytosis, and the assembly of macromolecular domains during signal transduction and receptor internalization.

These primary functions of the actin cytoskeleton are themselves regulated by the actin-modulating ABPs, which exhibit various activities towards F-actin, including bundling and crosslinking (Fimbrin, Fascin, Filamin A, etc.), membrane and receptor association (ERM proteins, among others), capping (CapZ, tropomodulin, etc.), anti-capping (Ena/VASP proteins), nucleating and branching (the Arp2/3 complex), nucleation and polymerizing (Spire1/2 and formins), actin-associated motor activity (Myosins), and severing functions (cofilin, gelsolin, etc.). Directly upstream of these factors and their associated activities are the Rho-family monomeric GTPases, which are activated by nucleotide exchange of bound GDP to GTP. The Rho GTPases, which include 20 members, are divided into canonical signaling motifs that mediate particular cellular processes (FIG. 1). Among these are the Rac1-PAK-LIMK-Cofilin pathway, which terminates with LIMK phosphorylating and inactivating cofilin; the Rac1-WAVE-Arp2/3 pathway, which promotes actin nucleation and branching, and lamellipodium generation; the Cdc42-WASP-Arp2/3 and Cdc42-mDia pathways, which activate Arp2/3 and the formin, mDia, respectively, and promote actin nucleation, branching, polymerization, and the formation of filopodia; and the RhoA-ROCK-LIMK-Cofilin and RhoA-ROCK-MLC pathways, which are partially responsible for the assembly of the contractile uropod, stress fibers, and focal adhesions.

It is these force-generating and scaffolding properties exhibited by the actin cytoskeleton and its effectors that frequently become targets of necessity for viral replication, which also require these activities. As discussed in details below, functions such as Arp2/3 nucleation and branching and formin-mediated actin polymerization are co-opted to produce force for viral motility. Similarly, the normal mechanisms of actin rearrangement, such as cofilin activation and inactivation cycling, are dysregulated to create favorable microcompartments for genome replication and nuclear localization. As such, each stage in the viral life cycle, from entry to egress and dissemination, will be considered in turn, explicating the various motifs of viral subversion of normal cellular actin signaling functions.

As a fundamental component of the host cellular cytoskeleton, actin is routinely engaged by infecting bacterial and viruses. Bacteria and Viruses from diverse groups, and infecting diverse hosts, have convergently evolved an array of mechanisms for manipulating the actin cytoskeleton for efficacious infection. The actin cytoskeleton is critical for viral infection at many stages of the life cycle, including binding, cell entry, nuclear localization, genomic transcription and reverse transcription, assembly, and egress/dissemination. Specifically, viruses subvert the force-generating and macromolecular scaffolding properties of the actin cytoskeleton to propel viral surfing, internalization, and migration within the cell. Additionally, viruses utilize the actin cytoskeleton to support and organize assembly sites, and eject budding virions for cell-to-cell transmission.

Actin and Viral Entry:

After engagement of the extracellular matrix (ECM) and the viral receptor, viruses must migrate to sites favorable for their particular mode of entry, whether it is direct plasma membrane fusion, or routes as divergent as macropinocytosis, phagocytosis, and the various forms of clathrin-mediated and clathrin-independent endocytosis. During this process, viruses frequently encounter actin-based processes, such as filopodia and microvilli, and utilize these structures to efficiently migrate to the cell membrane for entry.

Among the most common forms of this process is virus surfing, in which engagement of the receptor or ECM promotes movement of the attached virion towards the cell body in an actin-dependent mechanism. For instance, Lehmann et al. exhibited Murine leukemia virus (MLV), Avian leukosis virus (ALV), and Human immunodeficiency virus (HIV) surfing along filopodia in HEK293T cells transfected with their respective receptors (Lehmann M J, et al., 2005). MLV particles, in particular, migrated to the base of the filopodia and fused with the membrane, indicating that this was the active, and perhaps predominant, entry location (Lehmann M J, et al., 2005). Furthermore, this viral surfing was energy-dependent, being inhibited by sodium azide, and was dependent on functional myosin II and F-actin: treatment of cells with the myosin II inhibitor, blebbistatin, or cytochalasin D, which blocks F-actin barbed ends from polymerization, eliminated virus surfing and promoted random motility at the plasma membrane (Lehmann M J, et al., 2005). These treatments additionally inhibited MLV and ALV viral infection in rat XC cells, indicating that the viral surfing route contributed to productive infection (Lehmann M J, et al., 2005). The model developed around this process is centered around actin retrograde flow in which myosin II generates forces that pull the filopodia-associated actin filaments towards the cell body, which is commensurate with viral receptor-actin association and filopodial tip actin polymerization. The net result is that the virus-receptor complex is processively pushed and dragged towards the cell body where entry occurs.

Viral surfing on filopodia has also been described for Herpes simplex virus type 1 (HSV-1) (Clement C, et al., 2006; Dixit R, et al., 2008), vaccinia virus (Mercer J, et al., 2008), Human papilloma virus 16 (HPV-16) (Schelhaas M, et al., 2008), Hepatitis C virus (HCV) (Coller K E, et al., 2009), and HIV-1 (Lehmann M J, et al., 2005), indicating that utilization of actin retrograde flow in cellular processes, particularly filopodia, may be a general mechanism for extracellular viral migration towards the cell body. To some extent, the intracellular migration of viruses is a virus-dependent active process, requiring signal transduction from or clustering of the viral receptor. For instance, HSV-1 not only migrated upon filopodia, but dramatically induced their formation in P19 neuron-like cells (Dixit R, et al., 2008). This indicates that HSV-1 engagement of the viral receptor specifically introduces signaling events to mediate filopodia formation, implicating that Rho and PI3K-dependent pathways are critical for mediating cytoskeletal structures essential for viral infection (Clement C, et al., 2006; Zheng K, et al., 2014b).

As indicated above for HSV-1, another common theme preceding cell entry is that virus-receptor engagements can actively signal to the actin cytoskeleton. This receptor-mediated signaling can dramatically affect entry events, promoting receptor clustering, receptor endocytosis, and fusion complex stabilization. Additionally, these signal transduction events often have important impacts on subsequent events in the viral life cycle. For instance, binding of HIV-1 to the chemokine coreceptor CXCR4/CCR5 triggers the activation of Rac1-PAK1/2-LIMK-cofilin (Yoder A, et al., 2008; Vorster P J, et al., 2011). This signaling pathway regulates actin dynamics and the surface cycling of CXCR4, facilitating viral entry and post entry DNA synthesis and nuclear migration (Vorster P J, et al., 2011). Clustering of HIV-1 viral receptor and coreceptor (CD4 and either CCR5 or CXCR4) has also been suggested to be dependent on viral receptor signaling: specifically, engagement of both CD4 and CXCR4 activates Filamin A (Jiménez-Baranda S, et al., 2007), which promotes receptor motility and clustering. The ERM protein, Moesin, was also found to play a similar role in HIV-1 receptor clustering, in which the membrane receptor-actin crosslinking activity and receptor clustering occur after a viral receptor-mediated Moesin phosphorylation event (Barrero-Villar M, et al., 2009). It is probable that many other viruses utilize the actin cytoskeleton to induce receptor clustering and promote viral entry.

After engagement with the viral receptor, viral entry occurs either at the plasma membrane directly, or during/after internalization by one of the endocytic routes. Many, and perhaps all, of these routes depend on actin to one extent or another, particularly in primary, differentiated cells. For instance, macropinocytosis, which involves the Rac1-PAK-LIMK-Cofilin and, possibly, Rac1-WAVE-Arp2/3 pathways, has been shown to be required for HIV-1 entry into macrophages (Carter G C, et al., 2011). Macropinocytosis is also required for the entry of African swine fever virus (ASFV) (Sánchez E G, et al., 2012) and HPV-16 (Schelhaas M, et al., 2012). It also serves as an alternate entry route for Influenza A virus (IAV) (de Vries E, et al., 2011). An interesting twist on this is found in vaccinia virus entry, where viral envelope-associated phosphatidylserine induces an apoptotic body-mimicking signaling pathway, inducing a Rac1, PAK, tyrosine kinase, and actin-dependent macropinocytic entry route. Although, as reviewed by Moss (Moss B, 2012), the poxvirus entry fusion complex—composed of 11-12 glycosylated proteins—is abnormally complex, and other entry routes exist. Huttunem et al. (2014) also implicate a Rac1-dependent entry mechanism, involving neutral multivesicular bodies, in Coxsackievirus A9 entry (Huttunen M, et al., 2014). Similarly, HSV-1 has been shown to utilize a RhoA, tyrosine kinase, and actin-dependent phagocytosis-like route for entry (Clement C, et al., 2006; Zheng K, et al., 2014b). Poliovirus also utilizes an actin and tyrosine-kinase dependent route for entry, wherein genomic RNA release occurs in vesicles or membrane invaginations within 100-200 nm of the plasma membrane (Brandenburg B, et al., 2007). These examples, including many viruses from divergent groups, illuminate the need to co-opt the force generating and scaffolding functions of the cortical actin cytoskeleton, and the signaling pathways that modulate these functions, during viral entry.

Actin and Nuclear Migration:

After accessing the cortisol, most viruses must traverse the gap between the entry site and the nucleus for expression, genome replication, and, for some viruses, assembly. It is to this end that viruses utilize cellular force-generating apparatuses, which, along with dynein and kinesin for microtubule-based transport, include the motor and polymerizing proteins for the actin cytoskeleton; specifically, spire, formins, Arp2/3, and myosins. For instance, HIV-1 migrates to the nucleus utilizing two downstream components of Rac signaling, the Rac1-PAK1/2-LIMK-Cofiln pathway (Yoder A, et al., 2008; Vorster P J, et al., 2011), and the Rac1-WAVE2-Arp2/3 signaling pathway (Spear M, et al., 2014). The initial stimulus for Rac activation was also shown to require coreceptor—CCR5 or CXCR4—engagement and signal transduction (Yoder A, et al., 2008; Vorster P J, et al., 2011; Spear M, et al., 2014). Interestingly, from a potential therapeutic standpoint, treatment of CD4 T lymphocytes with the Arp2/3 inhibitor, CK-548 (Nolen B J, et al., 2009), dramatically reduced HIV-1 replication at dosages that did not affect CD4 T cell activation or induce cytotoxicity (Spear M, et al., 2014). For viruses with larger genomes, more elaborate mechanisms for mediating nuclear localization exist. This is the case with baculovirus, where the p78/83 capsid encodes a WASP/WAVE homology domain, the WASP homology-Cofilin homology/Connector-Acidic domain (WCA) (Machesky L M, et al., 2001). This domain is normally found in the Nuclear Promoting Factors (NPFs) of the WASP/WAVE family of proteins, whereupon NPF activation leads to WCA exposure and activation of the Arp2/3 complex for actin polymerization (Higgs H N, et al., 1999, 2001; Pollard T D, et al., 2003). However, in the presence of baculovirus p78/83, the viral WCA domain activates Arp2/3 at the viral core surface, generating forces and an actin comet tail that propel the core to the nucleus for expression and replication (Goley E D, et al., 2006; Ohkawa T, et al., 2010). As will be discussed later, nuclear translocation of the Arp2/3 complex, nuclear F-actin polymerization, and the resultant perturbation of nuclear structure also play a critical role during viral assembly and egress (Ohkawa T, et al., 1999; Goley E D, et al., 2006). HSV-1 has also been shown to utilize actin for intracellular motility and nuclear localization in a process involving the cofilin phosphatase and activator, slingshot, and calcium-regulated protease, calpain (Zheng K, et al., 2014a). The siRNA knockdown of slingshot and calpain reduced viral infection and led to a perinuclear localization of the viral cores, whereas wild-type virus localized to the nucleus efficaciously. In a somewhat stunning display of the requirements for specificity in actin signaling at distinct stages of viral replication, at later time points (8 hours post-infection and beyond), HSV-1 promotes ubiquitin/proteasome-dependent degradation of slingshot, leading to cofilin activation and promoting viral replication (Xiang Y, et al., 2014).

Actin in Assembly:

Once localized to the nucleus, or cytoplasm for large dsDNA viruses, viruses must concentrate, organize, and assemble their structural proteins, early-acting accessory and catalytic proteins, and genomic nucleic acids prior to egress of the viral particle. Needless to say, this requirement for colocalization of viral proteins, viral nucleic acids, and cellular factors requires scaffolding functions, and filamentous actin is often subverted for this purpose. This was shown for baculovirus: specifically, that mutation of the baculoviral CA domain dramatically abrogated nuclear F-actin accumulation and viral replication; furthermore, that viral progeny produced by one such mutant were distorted, either lacking an envelope altogether or having capsids that did not align with their envelope (Goley E D, et al., 2006).

In a similar fashion, Potato virus X (PVX), radically rearranges the ER and Golgi membranes and host actin into enormous assembly sites called the X-body (Tilsner J, et al., 2012). This process is mediated by the triple-gene block proteins (TGB1, 2, and 3), which are involved in cell-to-cell transfer through plasmodesmata, with PVX TGB1 being able to produce X-like-bodies when expressed alone (Tilsner J, et al., 2012). Although the role of actin in the X-body, and its relation to assembly was not specifically addressed, it has been shown that actin is required for intercellular transfer of PVX, in addition to Tobacco mosaic virus (TMV) and Tomato bushy stunt virus (TBSV), through plasmodesmata (Harries P A, et al., 2009). Thus, it is tempting to speculate that, even for certain plant viruses, actin may contribute to both assembly and cell-to-cell transfer.

Assembly of Influenza A virus (IAV) filamentous particles has also been shown to partially require an intact cortical actin cytoskeleton, as disruption with cytochalasin D (CCD) dramatically abrogated the titers of the filamentous, but not spherical, virions (Roberts P C, et al., 1998). This was later corroborated by Simpson-Holley et al. (2002), showing that treatment of MDCK cells with CCD, jasplakinolide (Jas), or latrunculin A (LatA) dramatically redistributed plasma membrane hemagglutinin (HA), lipid rafts, and actin into annular structures; there was also a commensurate loss of cell surface HA-containing filamentous projections and filamentous virus production (Simpson-Holley M, et al., 2002a). The authors attributed the loss of filamentous viral assembly not to actin playing a specific role in assembly, per se, but rather mobilizing and recruiting lipid rafts to the assembly sites of filamentous particles, which, given their size, require a much larger pool of lipids than their spherical particle counterparts. As such, with lipid rafts, actin, and HA reorganized into small annuli, only spherical particle production occurs owing to the lack of sufficient lipid raft material for the larger filamentous particles (Simpson-Holley M, et al., 2002b).

Measles virus (MeV) has also been shown to utilize actin during assembly. For instance, disruption of the actin cytoskeleton rapidly reduced MeV particle release from the plasma membrane (Stallcup K C, et al., 1983). Furthermore, actin has been observed to colocalize with budding MeV, with meromyosin-labeled actin barbed ends protruding into the nascent virions in close juxtaposition with the viral nucleocapsid (Bohn W, et al., 1986). Additionally, the viral Matrix protein (M) was found to associate with F-actin, and this was shown to reduce the interaction with viral hemagglutinin (H) protein, as CCD treatment dramatically reduced actin co-immunoprecipitating with M, while enhancing H co-immunoprecipitation (Wakimoto H, et al., 2013). This study also indicated that there is a tradeoff between M-actin affinity and viral infectivity, wherein a higher affinity between M and H increases the amount of H, and hence the infectivity, of cell-free virus at the expense of cell-cell fusion. Furthermore, mutations in the M protein affecting M-actin affinity may arise in cell types where cell-cell fusion is more productive than free viral infection (Wakimoto H, et al., 2013). In another study, Dietzel et al. (2013) exhibited that, while CCD treatment enhanced the rate of cell-cell fusion, it also reduces co-transport of M-RNP to the cell surface (Dietzel E, et al., 2013). Additionally, Jas treatment blocked free-virus production, while not affecting M-RNP co-transport, indicating that a dynamic actin cytoskeleton is required for cell-free virus maturation and release (Dietzel E, et al., 2013).

ROCK, LIMK, and cofilin have also been implicated in HIV-1 and Mason-Pfizer monkey virus assembly, release, and cell-cell transmission (Wen X, et al., 2014). Knockdown of LIMK did not inhibit HIV-1 maturation, yet, fully enveloped particles remained associated with the plasma membrane as mature virion aggregates (Wen X, et al., 2014). LIMK was also shown to be recruited to assembly sites (Wen X, et al., 2014). Although the exact mechanism for ROCK-LIMK-Cofilin contribution to virion release remains incompletely resolved, the authors suggested a factor retains the viral particles when normal cytoskeletal dynamics are disrupted (Wen X, et al., 2014).

Actin and Cell-Cell Transmission:

Cell-to-cell transmission of animal viruses is a highly efficacious route of dissemination that minimizes interactions with the innate and adaptive immune system. Additionally, this process can render certain antivirals less effective, giving the issue increasing prominence in therapeutic research (Agosto L M, et al., 2014). It constitutes the infection of neighboring cells by an infected cell, typically mediated by the fusogenic surface protein or envelope glycoprotein. Perhaps the best-studied example of this is Vaccinia virus cell-cell transmission (reviewed in (Welch M D, et al., 2013)). In 1976, Vaccinia virions were found to project from CCB-sensitive microvilli-like structures (Stokes G V, 1976); later, it was discovered that these virus-associated projections contained, in addition to actin, α-actinin (Hiller G, et al., 1979), fimbrin, and filamin (Hiller G, et al., 1981; Krempien U, et al., 1981). Additionally, Intracellular Enveloped Virions (IEVs) were shown to induce CCD-sensitive actin comet tails, reminiscent of *Listeria, Shigella* and *Rickettsia* infections (Cudmore S, et al., 1995). The actin comet-inducing factor, as identified by phenotypic characterization of deletion mutant viruses, was viral A36, a type 1b membrane protein (Röttger S, et al., 1999) that becomes tyrosine phosphorylated (Frischknecht F, et al., 1999a) at Y112 and Y132 (Frischknecht F, et al., 1999b). Y112 phosphorylation recruits the adaptor protein, Nck, via its SH2 domain (Frischknecht F, et al., 1999b), while Y132 was shown to recruit another adaptor protein, Grb2 (Scaplehorn N, et al., 2002). These proteins, in turn, help to recruit the N-WASP NPF complex (Frischknecht F, et al., 1999b; Moreau V, et al., 2000), which mediates Arp2/3 activation via its WCA domain. The result of this signaling cascade is the production of actin comet tails. When IEVs fuse with the plasma membrane, becoming Cell-associated Enveloped Virions (CEVs), viral A36 remains in the plasma membrane below the virion, promoting the production of the long, microvilli-like structures identified in 1976, and promoting viral dissemination (Welch M D, et al., 2013). Other factors that promote and regulate vaccinia virus motility are continually being discovered, including the formin, FHOD1, its upstream regulator, Rac1 (Alvarez D E, et al., 2013), and casein kinase 2 (Alvarez D E, et al., 2012).

HIV has also been shown to utilize an actin-dependent (Jolly C, et al., 2004, 2007) mode of transmission between T cells, in which viral Env glycoprotein on the donor cell organizes a polarized Virological Synapse (VS) that mediates highly efficient cell-cell transmission. This process may be up to 18,000 times more efficacious that free viral infection (Chen P, et al., 2007). Morphologically, the VS and associated signaling complex, which contains the viral receptor, CD4, and viral coreceptor, CXCR4 or CCR5, resembles the Supramolecular Activation Complex (SMAC) observed in T cell activation (Vasiliver-Shamis G, et al., 2008), including the incorporation of the T cell Receptor (TCR) (Vasiliver-Shamis G, et al., 2009). Although the derived signals are insufficient to promote T cell activation, they do create an actin-depleted zone, which may facilitate viral infection at its earliest stages (Vasiliver-Shamis G, et al., 2009). Additionally, HIV has been shown to transfer between T cells using cellular nanotube processes, which may mimic aspects of the VS (Sowinski S, et al., 2008). An interesting twist on these forms of cell-to-cell transmission can be found in infected dendritic cells (DCs), wherein viral filopodia, containing immature virions at their tips, were observed (Aggarwal A, et al., 2012). These viral filopodia were found to be quite dynamic, allowing up to 800 CD4 T cell contacts per hour (Aggarwal A, et al., 2012). Additionally, these viral filopodia partially required the formin, Diaphanous-2 (Diaph2), and the viral Nef accessory protein (Aggarwal A, et al., 2012).

Other Roles of Actin:

In addition to the more canonical modes of viral cooption of the actin cytoskeleton thus described, there is accumulating evidence that cytosolic and nuclear actin may play important roles in viral transcription, translation, and genome replication though somewhat unique modalities.

For instance, in HIV-1 infection, after entry into the host cell, the viral core is deposited on a dense meshwork of cortical actin that undergoes dynamics related to signal transduction mediated by the viral Env-CD4 and Env-CXCR4/CCR5 interactions (Jiménez-Baranda S, et al., 2007; Harmon B, et al., 2008, 2010; Yoder A, et al., 2008; Barrero-Villar M, et al., 2009; Vorster P J, et al., 2011; Spear M, et al., 2014). It is in this submembranous, dynamic actin cortex that the Reverse Transcriptase Complex (RTC) must convert the ssRNA genome into dsDNA. The first indication that the RTC may utilize the actin cytoskeleton came in 1995, when Hottiger et al. exhibited an interaction between beta-actin and the large subunit of Reverse Transcriptase (RT), or the Pol polyprotein precursor (Hottiger M, et al., 1995). Later, Bukrinskaya et al. (1998) corroborated these findings, showing that the RTC does indeed associate with the actin cytoskeleton in infected cells, and that pretreating cells with CCD, but not treatment 2 hours post-infection, reduced the accumulation of early and late reverse transcription products, with a more severe phenotype for late products (Bukrinskaya A, et al., 1998). These results indicated that actin disruption may directly impact the function of RT (Bukrinskaya A, et al., 1998). As was corroborated by later studies, CCD pretreatment reduced the nuclear accumulation of late RT products by 25-fold (Bukrinskaya A, et al., 1998). This process is presumably related to both the reliance on F-actin for both reverse transcription and nuclear migration of the Pre-Integration Complex (PIC) (Yoder A, et al., 2008; Cameron P U, et al., 2010; Vorster P J, et al., 2011; Spear M, et al., 2014). Although, the exact mechanism by which F-actin contributes to RTC activity remain unresolved. Nuclear actin bundles have also been implicated in late gene (gag) mRNA nuclear export and expression (Kimura T, et al., 2000): specifically, treatment with LatA, which disrupted viral Rev-RNP-induced nuclear actin bundles, caused retention of gag mRNA in the nucleus, decreasing cytosolic gag mRNA and, presumably, reducing Gag and Gag-Pol protein expression (Kimura T, et al., 2000).

Rac1 has also been shown to be important for Influenza A virus (IAV) polymerase complex activity (Dierkes R, et al., 2014). Treatment of cells with a Rac1 inhibitor, NSC23766 (Gao Y, et al., 2004), reduced viral replication in A549 cells with an IC50 of 22 µM (Dierkes R, et al., 2014). Furthermore, knockdown of TIAM1, the Rac1-activating GEF, or Rac1 itself also reduced viral replication (Dierkes R, et al., 2014). Additionally, NSC23766 reduced viral protein expression, which was later linked to inhibition of the viral polymerase complex (Dierkes R, et al., 2014). Fascinatingly, mice infected with IAV and treated with NSC23766 showed reduce titer of IAV in lung tissue, increased body weights, and a higher survivability than solvent-treated control mice (Dierkes R, et al., 2014). Although there was no specific study of whether NSC23766-mediated inhibition of the viral polymerase complex required actin, it is likely that actin played some role.

REFERENCES

Aggarwal A, Iemma T L, Shih I, Newsome T P, McAllery S, Cunningham A L, Turville S G. 2012. Mobilization of HIV spread by diaphanous 2 dependent filopodia in infected dendritic cells. PLoS Pathog, 8: e1002762.

Agosto L M, Zhong P, Munro J, Mothes W. 2014. Highly Active Antiretroviral Therapies Are Effective against HIV-1 Cell-to-Cell Transmission. PLoS Pathog, 10: e1003982.

Alvarez D E, Agaisse H. 2012. Casein kinase 2 regulates vaccinia virus actin tail formation. Virology, 423: 143-151.

Alvarez D E, Agaisse H. 2013. The formin FHOD1 and the small GTPase Rac1 promote vaccinia virus actin-based motility. J Cell Biol, 202: 1075-1090.

Barrero-Villar M, Cabrero J R, Gordón-Alonso M, Barroso-González J, Alvarez-Losada S, Muñoz-Fernández M A, Sánchez-Madrid F, Valenzuela-Fernández A. 2009. Moesin is required for HIV-1-induced CD4-CXCR4 interaction, F-actin redistribution, membrane fusion and viral infection in lymphocytes. J Cell Sci, 122: 103-113.

Bohn W, Rutter G, Hohenberg H, Mannweiler K, Nobis P. 1986. Involvement of actin filaments in budding of measles virus: studies on cytoskeletons of infected cells. Virology, 149: 91-106.

Brandenburg B, Lee L Y, Lakadamyali M, Rust M J, Zhuang X, Hogle J M. 2007. Imaging poliovirus entry in live cells. PLoS Biol, 5: e183.

Bukrinskaya A, Brichacek B, Mann A, Stevenson M. 1998. Establishment of a functional human immunodeficiency virus type 1 (HIV-1) reverse transcription complex involves the cytoskeleton. J Exp Med, 188: 2113-2125.

Cameron P U, Saleh S, Sallmann G, Solomon A, Wightman F, Evans V A, Boucher G, Haddad E K, Sekaly R-P, Harman A N, Anderson J L, Jones K L, Mak J, Cunningham A L, Jaworowski A, Lewin S R. 2010. Establishment of HIV-1 latency in resting CD4+ T cells depends on chemokine-induced changes in the actin cytoskeleton. Proc Natl Acad Sci USA, 107: 16934-16939.

Carter G C, Bernstone L, Baskaran D, James W. 2011. HIV-1 infects macrophages by exploiting an endocytic route dependent on dynamin, Rac1 and Pak1. Virology, 409: 234-250.

Chen P, Hübner W, Spinelli M A, Chen B K. 2007. Predominant mode of human immunodeficiency virus transfer between T cells is mediated by sustained Env-dependent neutralization-resistant virological synapses. J Virol, 81: 12582-12595.

Clement C, Tiwari V, Scanlan P M, Valyi-Nagy T, Yue BYJT, Shukla D. 2006. A novel role for phagocytosis-like uptake in herpes simplex virus entry. J Cell Biol, 174: 1009-1021.

Coller K E, Berger K L, Heaton N S, Cooper J D, Yoon R, Randall G. 2009. RNA interference and single particle tracking analysis of hepatitis C virus endocytosis. PLoS Pathog, 5: e1000702.

Cudmore S, Cossart P, Griffiths G, Way M. 1995. Actin-based motility of vaccinia virus. Nature, 378: 636-638.

Dierkes R, Warnking K, Liedmann S, Seyer R, Ludwig S, Ehrhardt C. 2014. The Rac1 inhibitor NSC23766 exerts anti-influenza virus properties by affecting the viral polymerase complex activity. PloS One, 9: e88520.

Dietzel E, Kolesnikova L, Maisner A. 2013. Actin filaments disruption and stabilization affect measles virus maturation by different mechanisms. Virol J, 10: 249.

Dixit R, Tiwari V, Shukla D. 2008. *Herpes simplex* virus type 1 induces filopodia in differentiated P19 neural cells to facilitate viral spread. Neurosci Lett, 440: 113-118.

Frischknecht F, Cudmore S, Moreau V, Reckmann I, Röttger S, Way M. 1999a. Tyrosine phosphorylation is required for actin-based motility of vaccinia but not *Listeria* or *Shigella*. Curr Biol CB, 9: 89-92.

Frischknecht F, Moreau V, Röttger S, Gonfloni S, Reckmann I, Superti-Furga G, Way M. 1999b. Actin-based motility of vaccinia virus mimics receptor tyrosine kinase signalling. Nature, 401: 926-929.

Gao Y, Dickerson J B, Guo F, Zheng J, Zheng Y. 2004. Rational design and characterization of a Rac GTPase-specific small molecule inhibitor. Proc Natl Acad Sci USA, 101: 7618-7623.

Goley E D, Ohkawa T, Mancuso J, Woodruff J B, D'Alessio J A, Cande W Z, Volkman L E, Welch M D. 2006. Dynamic Nuclear Actin Assembly by Arp2/3 Complex and a Baculovirus WASP-Like Protein. Science, 314: 464-467.

Harmon B, Campbell N, Ratner L. 2010. Role of Abl kinase and the Wave2 signaling complex in HIV-1 entry at a post-hemifusion step. PLoS Pathog, 6: e1000956.

Harmon B, Ratner L. 2008. Induction of the Galpha(q) signaling cascade by the human immunodeficiency virus envelope is required for virus entry. J Virol, 82: 9191-9205.

Harries P A, Park J-W, Sasaki N, Ballard K D, Maule A J, Nelson R S. 2009. Differing requirements for actin and myosin by plant viruses for sustained intercellular movement. Proc Natl Acad Sci USA, 106: 17594-17599.

Higgs H N, Pollard T D. 1999. Regulation of actin polymerization by Arp2/3 complex and WASp/Scar proteins. J Biol Chem, 274: 32531-32534.

Higgs H N, Pollard T D. 2001. Regulation of actin filament network formation through ARP2/3 complex: activation by a diverse array of proteins. Annu Rev Biochem, 70: 649-676.

Hiller G, Jungwirth C, Weber K. 1981. Fluorescence microscopical analysis of the life cycle of vaccinia virus in chick embryo fibroblasts. Virus-cytoskeleton interactions. Exp Cell Res, 132: 81-87.

Hiller G, Weber K, Schneider L, Parajsz C, Jungwirth C. 1979. Interaction of assembled progeny pox viruses with the cellular cytoskeleton. Virology, 98: 142-153.

Hottiger M, Gramatikoff K, Georgiev O, Chaponnier C, Schaffner W, Hübscher U. 1995. The large subunit of HIV-1 reverse transcriptase interacts with beta-actin. Nucleic Acids Res, 23: 736-741.

Huttunen M, Waris M, Kajander R, Hyypiä T, Marjomäki V. 2014. Coxsackievirus A9 infects cells via nonacidic multivesicular bodies. J Virol, 88: 5138-5151.

Jiménez-Baranda S, Gómez-Moutón C, Rojas A, Martinez-Prats L, Mira E, Ana Lacalle R, Valencia A, Dimitrov D S, Viola A, Delgado R, Martinez-A C, Mañes S. 2007. Filamin-A regulates actin-dependent clustering of HIV receptors. Nat Cell Biol, 9: 838-846.

Jolly C, Kashefi K, Hollinshead M, Sattentau Q J. 2004. HIV-1 cell to cell transfer across an Env-induced, actin-dependent synapse. J Exp Med, 199: 283-293.

Jolly C, Mitar I, Sattentau Q J. 2007. Requirement for an intact T-cell actin and tubulin cytoskeleton for efficient assembly and spread of human immunodeficiency virus type 1. J Virol, 81: 5547-5560.

Kimura T, Hashimoto I, Yamamoto A, Nishikawa M, Fujisawa J I. 2000. Rev-dependent association of the intron-containing HIV-1 gag mRNA with the nuclear actin bundles and the inhibition of its nucleocytoplasmic transport by latrunculin-B. Genes Cells Devoted Mol Cell Mech, 5: 289-307.

Krempien U, Schneider L, Hiller G, Weber K, Katz E, Jungwirth C. 1981. Conditions for pox virus-specific microvilli formation studied during synchronized virus assembly. Virology, 113: 556-564.

Lehmann M J, Sherer N M, Marks C B, Pypaert M, Mothes W. 2005. Actin- and myosin-driven movement of viruses along filopodia precedes their entry into cells. J Cell Biol, 170: 317-325.

Machesky L M, Insall R H. 2001. WASP homology sequences in baculoviruses. Trends Cell Biol, 11: 286-287.

Mercer J, Helenius A. 2008. Vaccinia virus uses macropinocytosis and apoptotic mimicry to enter host cells. Science, 320: 531-535.

Moss B. 2012. Poxvirus cell entry: how many proteins does it take? Viruses, 4: 688-707.

Moreau V, Frischknecht F, Reckmann I, Vincentelli R, Rabut G, Stewart D, Way M. 2000. A complex of N-WASP and WIP integrates signalling cascades that lead to actin polymerization. Nat Cell Biol, 2: 441-448.

Nolen B J, Tomasevic N, Russell A, Pierce D W, Jia Z, McCormick C D, Hartman J, Sakowicz R, Pollard T D. 2009. Characterization of two classes of small molecule inhibitors of Arp2/3 complex. Nature, 460: 1031-1034.

Ohkawa T, Volkman L E, Welch M D. 2010. Actin-based motility drives baculovirus transit to the nucleus and cell surface. J Cell Biol, 190: 187-195.

Ohkawa T, Volkman L E. 1999. Nuclear F-Actin Is Required for AcMNPV Nucleocapsid Morphogenesis. Virology, 264: 1-4.

Pollard T D, Borisy G G. 2003. Cellular motility driven by assembly and disassembly of actin filaments. Cell, 112: 453-465.

Roberts P C, Compans R W. 1998. Host cell dependence of viral morphology. Proc Natl Acad Sci USA, 95: 5746-5751.

Röttger S, Frischknecht F, Reckmann I, Smith G L, Way M. 1999. Interactions between vaccinia virus IEV membrane proteins and their roles in IEV assembly and actin tail formation. J Virol, 73: 2863-2875.

Sánchez E G, Quintas A, Pérez-Núñez D, Nogal M, Barroso S, Carrascosa Á L, Revilla Y. 2012. African swine fever virus uses macropinocytosis to enter host cells. PLoS Pathog, 8: e1002754.

Scaplehorn N, Holmström A, Moreau V, Frischknecht F, Reckmann I, Way M. 2002. Grb2 and Nck act cooperatively to promote actin-based motility of vaccinia virus. Curr Biol CB, 12: 740-745.

Schelhaas M, Ewers H, Rajamäki M-L, Day P M, Schiller J T, Helenius A. 2008. Human papillomavirus type 16 entry: retrograde cell surface transport along actin-rich protrusions. PLoS Pathog, 4: e1000148.

Schelhaas M, Shah B, Holzer M, Blattmann P, Kühling L, Day P M, Schiller J T, Helenius A. 2012. Entry of Human Papillomavirus Type 16 by Actin-Dependent, Clathrin- and Lipid Raft-Independent Endocytosis. PLoS Pathog, 8: e1002657.

Simpson-Holley M, Ellis D, Fisher D, Elton D, McCauley J, Digard P. 2002a. A functional link between the actin cytoskeleton and lipid rafts during budding of filamentous influenza virions. Virology, 301: 212-225.

Simpson-Holley M, Ellis D, Fisher D, Elton D, McCauley J, Digard P. 2002b. A Functional Link between the Actin Cytoskeleton and Lipid Rafts during Budding of Filamentous Influenza Virions. Virology, 301: 212-225.

Sowinski S, Jolly C, Berninghausen O, Purbhoo M A, Chauveau A, Kohler K, Oddos S, Eissmann P, Brodsky F M, Hopkins C, Onfelt B, Sattentau Q, Davis D M. 2008. Membrane nanotubes physically connect T cells over long distances presenting a novel route for HIV-1 transmission. Nat Cell Biol, 10: 211-219.

Spear M, Guo J, Turner A, Yu D, Wang W, Meltzer B, He S, Hu X, Shang H, Kuhn J, Wu Y. 2014. HIV-1 Triggers WAVE2 Phosphorylation in Primary CD4 T Cells and Macrophages, Mediating Arp2/3-dependent Nuclear Migration. J Biol Chem, 289: 6949-6959.

Stallcup K C, Raine C S, Fields B N. 1983. Cytochalasin B inhibits the maturation of measles virus. Virology, 124: 59-74.

Stokes G V. 1976. High-voltage electron microscope study of the release of vaccinia virus from whole cells. J Virol, 18: 636-643.

Tilsner J, Linnik O, Wright K M, Bell K, Roberts A G, Lacomme C, Santa Cruz S, Oparka K J. 2012. The TGB1 movement protein of Potato virus X reorganizes actin and endomembranes into the X-body, a viral replication factory. Plant Physiol, 158: 1359-1370.

Vasiliver-Shamis G, Cho M W, Hioe C E, Dustin M L. 2009. Human Immunodeficiency Virus Type 1 Envelope gp120-Induced Partial T-Cell Receptor Signaling Creates an F-Actin-Depleted Zone in the Virological Synapse. J Virol, 83: 11341-11355.

Vasiliver-Shamis G, Tuen M, Wu T W, Starr T, Cameron T O, Thomson R, Kaur G, Liu J, Visciano M L, Li H, Kumar R, Ansari R, Han D P, Cho M W, Dustin M L, Hioe C E. 2008. Human immunodeficiency virus type 1 envelope gp120 induces a stop signal and virological synapse formation in noninfected CD4+ T cells. J Virol, 82: 9445-9457.

Vorster P J, Guo J, Yoder A, Wang W, Zheng Y, Xu X, Yu D, Spear M, Wu Y. 2011. LIM kinase 1 modulates cortical actin and CXCR4 cycling and is activated by HIV-1 to initiate viral infection. J Biol Chem, 286: 12554-12564.

De Vries E, Tscherne D M, Wienholts M J, Cobos-Jiménez V, Scholte F, Garcia-Sastre A, Rottier P J M, de Haan C A M. 2011. Dissection of the Influenza A Virus Endocytic Routes Reveals Macropinocytosis as an Alternative Entry Pathway. PLoS Pathog, 7: e1001329.

Wakimoto H, Shimodo M, Satoh Y, Kitagawa Y, Takeuchi K, Gotoh B, Itoh M. 2013. F-Actin Modulates Measles Virus Cell-Cell Fusion and Assembly by Altering the Interaction between the Matrix Protein and the Cytoplasmic Tail of Hemagglutinin. J Virol, 87: 1974-1984.

Welch M D, Way M. 2013. Arp2/3-Mediated Actin-Based Motility: A Tail of Pathogen Abuse. Cell Host Microbe, 14: 242-255.

Wen X, Ding L, Wang J-J, Qi M, Hammonds J, Chu H, Chen X, Hunter E, Spearman P. 2014. ROCK1 and LIM Kinase Modulate Retrovirus Particle Release and Cell-Cell Transmission Events. J Virol; DOI: 10.1128/JVI.00023-14.

Xiang Y, Zheng K, Zhong M, Chen J, Wang X, Wang Q, Wang S, Ren Z, Fan J, Wang Y. 2014. Ubiquitin-proteasome-dependent slingshot 1 downregulation in neuronal cells inactivates cofilin to facilitate HSV-1 replication. Virology, 449: 88-95.

Yoder A, Yu D, Dong L, Iyer S R, Xu X, Kelly J, Liu J, Wang W, Vorster P J, Agulto L, Stephany D A, Cooper J N, Marsh J W, Wu Y. 2008. HIV envelope-CXCR4 signaling activates cofilin to overcome cortical actin restriction in resting CD4 T cells. Cell, 134: 782-792.

Zheng K, Xiang Y, Wang Q, Jin F, Chen M, Ma K, Ren Z, Wang Y. 2014a. Calcium-signal facilitates herpes simplex virus type 1 nuclear transport through slingshot 1 and calpain-1 activation. Virus Res, 188C: 32-37.

Zheng K, Xiang Y, Wang X, Wang Q, Zhong M, Wang S, Wang X, Fan J, Kitazato K, Wang Y. 2014b. Epidermal growth factor receptor-PI3K signaling controls cofilin activity to facilitate herpes simplex virus 1 entry into neuronal cells. mBio, 5: e00958-00913.

Actin-Based Peptides can Inhibit or Enhance Bacterial Infection Through Inhibiting Bacterial Motility and Mobility Actin and Bacterial Mobility:

The cytoskeleton is a dynamic structure composed of microfilaments (filamentous actin or F-actin), intermediate filaments, and microtubules that are mainly responsible for defining cell shape, mediating motility, and transporting macromolecules and organelles. The actin cytoskeleton, in particular, has been shown to be the driving force for cell motility and migration [1]. As an integral component of intracellular molecular networks, the actin cytoskeleton is also a target for pathogens. It has been known that the human bacterial pathogens *Listeria monocytogenes* [2, 3] effectively uses the driving force generated from actin polymerization for mobility.

Actin-Based Peptides Cause Receptor Up/Down Regulation

Mattila and co-authors have suggested that actin regulates receptors through controlling receptor compartmentalization, receptor dynamics, and receptor clustering [4]. Actin cytoskeleton is also a point of integration for receptor cross talk through modulation of protein dynamics and clustering.

Gowriskankar and coauthors [5] have also proposed a model in which active remodeling of cortical actin regulates spatiotemporal organization of cell surface molecules such as surface receptors. The authors classify surface molecules into 3 classes based on their relationship with the cortical actin—namely, inert surface molecules, passive surface molecules, and active surface molecules. The inert (e.g. short-chain lipids) and passive (e. g. transmembrane proteins with actin-binding domains) molecules on the cell surface can be driven to form transient nanoclusters by actin dynamics and local actin architecture. Many cell surface proteins can directly connect to the cytoplasmic actin using actin-binding motifs such as PDZ, SH3 (Src- or PRD (proline-rich domain). Active cell surface molecules (e.g. integrin and T cell receptors) are capable of interacting with actin and modifying its dynamics. These molecules can recruit molecules involved in actin remodulation. They can also be organized in microclusters by actin-dependent processes.

The instant actin-based peptides can modulate cell surface molecules and receptors through promoting or inhibiting actin dynamics.

For example, and in no way limiting, the instant actin-based peptides can modulate cancer receptors. A review article describing the most important cancer receptors is A. M. Scott et al., Antibody therapy of cancer, *Nature Reviews Cancer*, Vol. 12, APRIL 2012, 278-287. Table 2 in the article lists important receptors that can be targeted for therapy (e.g, CD20, CD30, CD33, CD52, EpCAM, CEA, gpA33, Mucins, TAG-72, CAIX, PSMA, VEGF, VEGFR, EGFR, Integrin $\alpha V\beta 3$, Integrin $\alpha 5\beta 3$, ERBB2, ERBB3, EPHA3, TRAILR1, RANKL, FAP, Tenascin)

REFERENCES

[1]. Pollard T D, Borisy G G. Cellular motility driven by assembly and disassembly of actin filaments. Cell. 2003; 112(4):453-65. PubMed PMID: 12600310.
[2]. Loisel T P, Boujemaa R, Pantaloni D, Carlier M F. Reconstitution of actin-based motility of *Listeria* and *Shigella* using pure proteins. Nature. 1999; 401(6753): 613-6. PubMed PMID: 10524632.
[3]. Cameron L A, Giardini P A, Soo F S, Theriot J A. Secrets of actin-based motility revealed by a bacterial pathogen. Nat Rev Mol Cell Biol. 2000; 1(2):110-9. PubMed PMID: 11253363.
[4]. Mattila P K, Batista F D, Treanor B. Dynamics of the actin cytoskeleton mediates receptor cross talk: An emerging concept in tuning receptor signaling. J Cell Biol. 2016; 212(3):267-80. doi: 10.1083/jcb.201504137. PubMed PMID: 26833785; PMCID: PMC4748574.
[5]. Gowrishankar K, Ghosh S, Saha S, C R, Mayor S, Rao M. Active remodeling of cortical actin regulates spatiotemporal organization of cell surface molecules. Cell. 2012; 149(6):1353-67. doi: 10.1016/j.cell.2012.05.008. PubMed PMID: 22682254.

The Instant Actin-Based Peptides Provide Anti-Inflammatory/Inhibit Cheomotaxis:

Actin polymerization is the major driving force for the chemotaxis of immune cells. It is known that inhibiting actin polymerization inhibits chemotaxis, which is required for the inflammatory responses of immune cells. The instant actin-based peptides can interfere with actin polymerization process, and may possess anti-inflammatory properties.

REFERENCE

1. Felgner P L, Gadek T R, Holm M, Roman R, Chan H W, Wenz M, Northrop J P, Ringold G M, Danielsen M. Lipofection: a highly efficient, lipid-mediated DNA-transfection procedure. Proc Natl Acad Sci USA. 1987; 84(21): 7413-7. PubMed PMID: 2823261; PMCID: PMC299306.

EXAMPLES—ILLUSTRATIVE EXAMPLES ARE PRESENTED BELOW. THEY ARE EXEMPLARY AND NON-LIMITING

Example 1: Human and Related Composition

As exemplified in FIG. 1 and FIG. 2, the amino acid (AA) sequence of human beta-actin, which has 375 amino acids (L=375), can be divided into multiple overlapping fragments (in L- or D-form peptides) with various lengths (P). The total number of peptides (N) can be generated will be: N=L-P, where N=total number of peptides that could be generated, L=the number of amino acids in an actin protein isoform. P=the number of amino acids in an actin peptide, P can be from 2 amino acids to (L-1) amino acids. As exemplified in FIG. 1A, human beta-actin can be divided into multiple peptides (N=375-20=350) of 20 AA in length. These peptides can be chemically conjugated to a cell penetration peptide or member-permeable molecules (either in the N terminus or the C terminus) for intracellular delivery (FIG. 1B). Conjugation is well known in the chemical arts, and can occur by any art-accepted method.

Example 2: Enhancement of HIV Infection by Actin-Based Peptide N7 and N9

In screening a peptide library (FIG. 1C), multiple peptides including Peptide N7 and N9 were identified that can drastically enhance HIV infection of human T cells (FIG. 1C). As shown in FIG. 3, the actin-based peptides N7 and N9 enhance HIV infection. The HIV Rev-dependent indicator cell, Rev-CEM-GFP, was not infected (+Cell) or infected with HIV-1 (+HIV), or pre-treated with peptide N7, and then infected with HIV-1 (N7+HIV). Following infection for 2 hours, cells were washed to remove the virus and the peptide. Viral replication was measured at 2 days post infection by flow cytometry.

N7 enhances HIV infection from 0.79% to 15.5%, as measured by the percentage of GFP+ cells. PI, propidium iodide, was added before flow cytometry for cytotoxicity control. GFP+ cells were counted only when the cells are viable (low PI staining).

Figure 6:
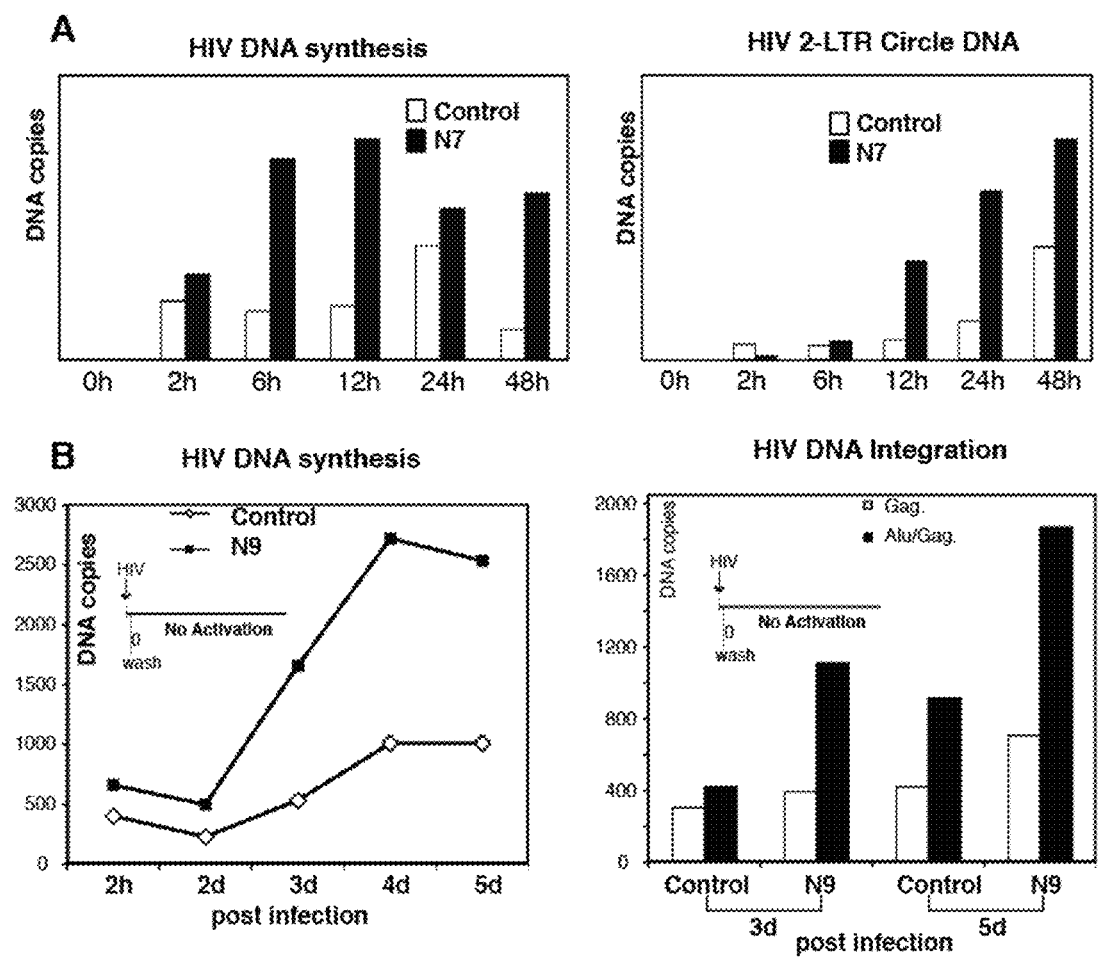
FIG. 6: Peptide N7 and N9 enhance HIV DNA synthesis, nuclear migration, and integration. (A) CEM-SS T cells were treated with N7 during HV infection for 2 hours, washed, and then analyzed for viral DNA synthesis and 2-LTR circles, a marker for HIV nuclear migration. (B) Blood resting CD4 T cells were similar infected, washed, and cultured without T cell activation. Viral DNA synthesis and DNA integration were analyzed.

Similar effects were observed and measured for peptide N9. N9 enhanced HIV infection from 1.95% to 14.07%.

Example 3: Peptide N7 Up-Regulates Surface Receptors

As shown in FIG. 4, exposure of T cells to Peptide N7 was also found to drastically up-regulate the surface CXCR4 receptors, while there were a moderate up-regulation of the surface CD4 receptor (FIG. 4). Mechanistic studies revealed that Peptide N7 briefly triggers cofilin activation and actin depolymerization (FIG. 5), likely causing a transient breakage of the cortical actin layer, leading to higher levels of surface receptors, HIV viral entry, viral DNA synthesis, and nuclear migration (FIG. 6).

Experimental Procedure of N7 Up-Regulation of Surface Receptors:
1) Culture human CEM-SS T cells at $5\times10^5$ cells/ml
2) Add peptide N7 to the cell to a final concentration of 10 uM at various times from 5 min to 120 min (e. g. 5, 10, 15, 30, 45, 60, 120 min).
3) Take out 1-$2\times10^5$ cells, put on ice, perform routine surface staining using FITC-, PE- or PE-cy5-labelled specific antibodies against cell receptors as recommended by the reagent manufacturer for cell surface staining.
4) Analyzed the staining by flow cytometer.

Example 4: Peptide N7 and N9 Modulate Cofilin and Actin Activity

Figure 5:
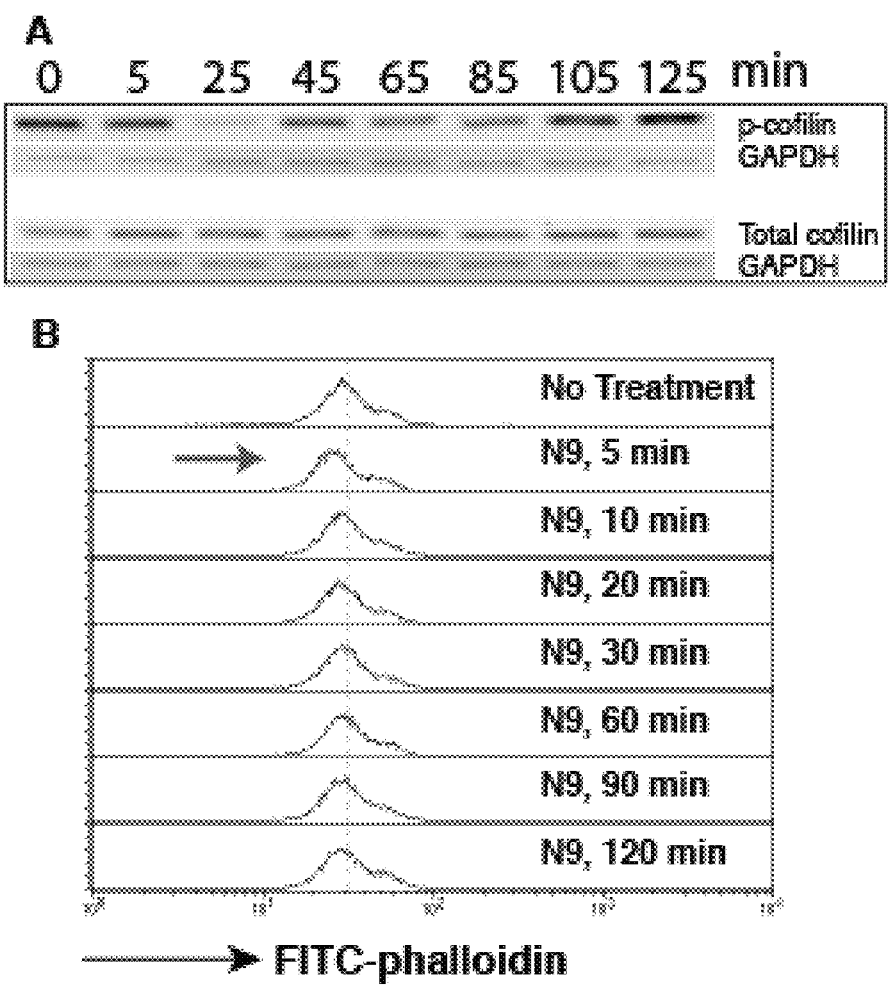
FIG. 5: Peptide N7 and N9 modulate cell signal transduction and chemotactic cofilin and actin activity. (A) Resting memory CD4 T cells were treated with N7 for a time course, cofilin phosphorylation was measured by Western Blot. Total cofilin and GAPDH was also measured for loading control. (B) Resting CD4 T cells were treated with N9, and actin polmerization and depolymerization were measured by FITC-phalloidin staining.

Resting memory CD4 T cells were treated with N7 for a time course, and cofilin phosphorylation was measured by Western Blot. Total cofilin and GAPDH was also measured for loading control (FIG. 5A). Resting CD4 T cells were treated with N9, and actin polmerization and depolymerization were measured by FITC-phalloidin staining (FIG. 5B). See FIG. 5.

Example 5: Peptide N7 and N9 Enhance HIV DNA Synthesis, Nuclear Migration, and Integration As shown in FIG. 6, peptide N7 and N9 enhance HIV DNA synthesis, nuclear migration, and integration. CEM-SS T cells were treated with N7 during HV infection for 2 hours, washed, and then analyzed for viral DNA synthesis and 2-LTR circles, a marker for HIV nuclear migration. See FIG. 6(A). Blood resting CD4 T cells were similar infected, washed, and cultured without T cell activation. Viral DNA synthesis and DNA integration were analyzed. See FIG. 6(B).

Figure 7:
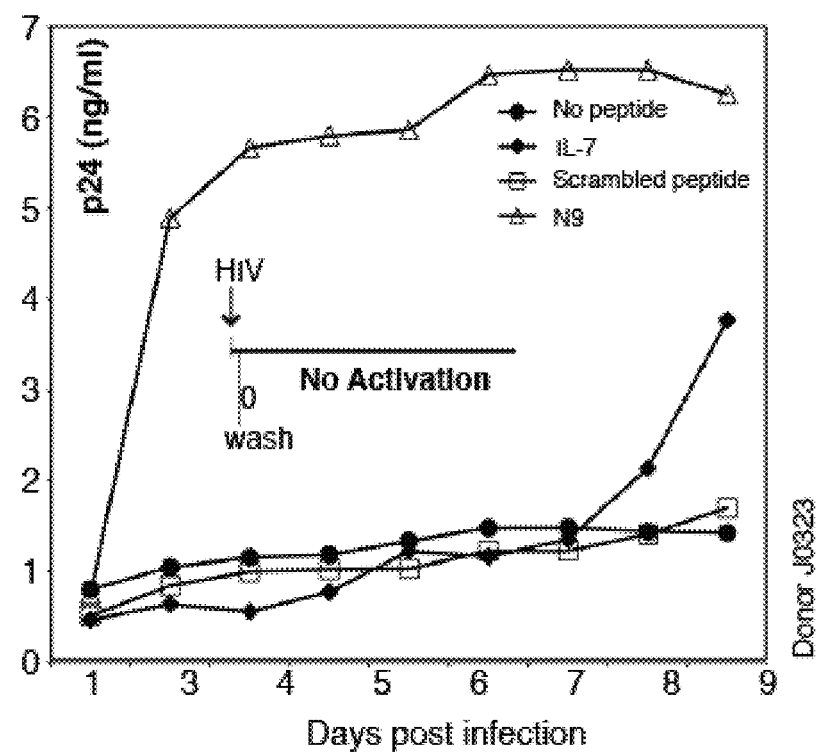
FIG. 7: Peptide N9 promotes HIV infection of resting CD4 T cells. Resting CD4 T cells were treated with N9, and then infected with HIV for 2 hours. Following infection, cells were washed, and culture in the absence of T cell activation and N9. Viral p24 release was measured. As controls, cells were culture with the addition of IL-7 (daily addition), or with a scrambled peptide, or only in the culture medium.

The ability of N9 to stimulate HIV infection of blood resting CD4 T cells was also tested. Resting CD4 T cells are relatively resistant to HIV infection. The lack of activity in the cortical actin limits viral early steps in the infection of resting T cells (Yoder et al., 2008). As shown in FIG. 7, a single-dosage N9 treatment prior to HIV infection drastically stimulated HIV infection of resting T cells. Importantly, this enhancement occurs in the absence of T cell activation or cytokine stimulation, and N9 is more potent at early time in stimulating viral infection than certain cytokines such as IL-7 (administered daily).

Assay Protocols for Using Peptides of the Invention

Example 6: Protocol for Using Actin-Based Peptides to Enhance Viral Infection

1) Culture human T cell in growth medium
2) Take 1-$2\times10^6$ cells, resuspend into $2\times10^6$ per ml
3) Add actin-peptides to cell to a final concentration of 10 uM
4) Incubate for 1-2 hours
5) Add viruses (e. g. 100-500 ul), and then add additional amount of actin-peptide to maintain the final concentration to 10 uM
6) Infect cells for 1-4 hours
7) Wash cells to remove the virus and the peptide
8) Culture for 1-7 days post infection to monitor viral replication.

Example 7: Protocol for Using Actin-Based Peptides to Block Cell Migration (Chemotaxis)

1) Take $0.5\times10^5$ cells, resuspend into 100 ul medium
2) Treat cells with actin-peptide for 1-2 hours 3) Add cells to the upper chamber of a 24-well transwell plate (corning)
4) The lower chamber is filled with 600 ul medium premixed with SDF-1 (40 ng/ml).
5) Incubate the plate at 37° C. for 2 hours
6) The upper chamber was removed, and cells in the lower chamber was counted.

Example 8: Results and Protocol for Using Peptide N10 to Kill Cancer Cells

We found that treatment of human T lymphoma cells with N10 led to the killing of T cells (FIG. 8). FIG. 8 shows human T lymphoblast cell A3.01 was treated with N10 (10 uM). N10-mediated cell killing was monitored by staining of dead cells with Propidium iodide and FITC-labelled Annexin V. Cells were analyzed by flow cytometry.

Experimental Procedure

5) Culture human A3.01 cells at $5\times10^5$ cells/ml
6) Add peptide N10 to the cell to a final concentration of 10 uM
7) Continue to culture cell at 37° C., maintain cell density below $1\times10^6$ cells/ml 8) Take out 1-$2\times10^5$ cells, put on ice, add P.I., and FITC—Annexin V as recommended by the reagent manufacturer for dead/apoptotic cell staining.
9) Analyzed the staining by flow cytometer.

REFERENCES

Kotsakis, A., Pomeranz, L. E., Blouin, A., and Blaho, J. A. (2001). Microtubule reorganization during herpes simplex virus type 1 infection facilitates the nuclear localization of VP22, a major virion tegument protein. J Virol 75, 8697-8711.

Pollard, T. D., and Borisy, G. G. (2003). Cellular motility driven by assembly and disassembly of actin filaments. Cell 112, 453-465.

Spear, M., Guo, J., and Wu, Y. (2012). The trinity of the cortical actin in the initiation of HIV-1 infection. Retrovirology 9, 45.

Spear, M., Guo, J., and Wu, Y. (2013). Novel anti-HIV therapeutics targeting chemokine receptors and actin regulatory pathways. Immunological Reviews DOI: 10.1111imr.12106.

Taylor, M. P., Koyuncu, O. O., and Enquist, L. W. (2011). Subversion of the actin cytoskeleton during viral infection. Nat Rev Microbiol 9, 427-439.

Wulfing, C., and Davis, M. M. (1998). A receptor/cytoskeletal movement triggered by costimulation during T cell activation. Science 282, 2266-2269.

Yoder, A., Yu, D., Dong, L., Iyer, S. R., Xu, X., Kelly, J., Liu, J., Wang, W., Vorster, P. J., Agulto, L., et al. (2008). HIV envelope-CXCR4 signaling activates cofilin to overcome cortical actin restriction in resting CD4 T cells. Cell 134, 782-792.

The following sequences are essentially derived from the core domains of the actin-based bioactive peptides: NB5 (SEQ ID NO: 853), NB7 (SEQ ID NO: 854), NB9 (SEQ ID NO: 855), NB10 (SEQ ID NO: 856), B11 (SEQ ID NO: 857), B17 (SEQ ID NO: 858) (FIG. 2). These include 40 AA centered around each core domain, also all the possible 20 AA that can be derived around the core domain, and all the possible 10 AA that can be derived around the core domain.

Also listed are multiple mutations on the 40AA, 20 AA, and 10 AA (X, X0 equal all possible AA).

$(G/A)_{0-20}$=0 to 20 amino acids of either G or A in each position.

X0=any one of the natural and un-natural amino acids.

X=any one of the natural and un-natural amino acids.

The amino acid in any of the position in all of the sequences can be replaced by an amino acid that belongs to the same amino acid group as listed in Table 1. (Table 1, Group 1=R, H, K; Group 2=D, E; Group 3=S, T, N, Q; Group 4=A, I, L, M, F, W, Y, V; Group 5=C, U, G, P)

TABLE 1

| Twenty-One Amino Acids | | |
|---|---|---|
| Group 1 | Amino acids with positively charged side chain | R = Arginine (Arg)<br>H = Histidine (His)<br>K = Lysine (Lys) |
| Group 2 | Amino acids with negatively charged side chain | D = Aspartic acid (Asp)<br>E = Glutamic acid (Glu) |
| Group 3 | Amino acids with polar uncharged side chain | S = Serine (Ser)<br>T = Threonine (Thr)<br>N = Asparagine (Asn)<br>Q = Glutamine (Gln) |
| Group 4 | Amino acids with hydrophobic side chain | A = Alanine (Ala)<br>I = Isoleucine (Ile)<br>L = Leucine (Leu)<br>M = Methionine (Met)<br>F = Phenylalanine (Phe)<br>W = Tryptophan (Trp)<br>Y = Tyrosine (Tyr)<br>V = Valine (Val) |
| Group 5 | Amino acids with special cases | C = Cysteine (Cys)<br>U = Selenocysteine (Sec)<br>G = Glycine (Gly)<br>P = Proline (Pro) |

A peptide sequence of the invention includes one or more of the following:

| ID (Name) | Peptide Sequence (N to C) |
|---|---|
| SEQ ID NO: 1(NB5-core): | RRRRRRRR$(G/A)_{0-20}$YNELRVAPEE |
| SEQ ID NO: 2(NB7-core): | RRRRRRRR$(G/A)_{0-20}$QIMFETFNTP |
| SEQ ID NO: 3(NB9-core): | RRRRRRRR$(G/A)_{0-20}$LPHAILRLDL |
| SEQ ID NO: 4(NB10-core): | RRRRRRRR$(G/A)_{0-20}$AGRDLTDYLM |
| SEQ ID NO: 5(B11-core): | RRRRRRRR$(G/A)_{0-20}$LCYVALDFEQ |
| SEQ ID NO: 6(B17-core): | RRRRRRRR$(G/A)_{0-20}$KYSVWIGGSI |
| SEQ ID NO: 7(B5-20AA): | RRRRRRRR$(G/A)_{0-20}$YNELRVAPEEHPVLLTEAPL |
| SEQ ID NO: 8(B6-20AA): | RRRRRRRR$(G/A)_{0-20}$NPKANREKMTQIMFETENTP |
| SEQ ID NO: 9(N7-20AA): | RRRRRRRR$(G/A)_{0-20}$QIMFETENTPAMYVAIQAVL |
| SEQ ID NO: 10(N9-20AA): | RRRRRRRR$(G/A)_{0-20}$HTVRIYEGYALRHAILRLDL |
| SEQ ID NO: 11(B9-20AA): | RRRRRRRR$(G/A)_{0-20}$LPHAILRLDLAGRDLTDYLM |
| SEQ ID NO: 12(N10-20AA): | RRRRRRRR$(G/A)_{0-20}$AGRDLTDYLMKILTERGYSF |
| SEQ ID NO: 13(B11-20AA): | RRRRRRRR$(G/A)_{0-20}$DIKEKLCYVALDFEQEMATA |
| SEQ ID NO: 14(B17-20AA): | RRRRRRRR$(G/A)_{0-20}$APPERKYSVWIGGSILASLS |
| SEQ ID NO: 15(NB5-V1): | $(X)_{0-20}$(X)NELRVAPEE$(X)_{0-20}$ |
| SEQ ID NO: 16(NB5-V2): | $(G/A)_{0-20}$Y(X)ELRVAPEE$(G/A)_{0-20}$ |
| SEQ ID NO: 17(NB5-V3): | $(G/A)_{0-20}$YN(X)LRVAPEE$(G/A)_{0-20}$ |
| SEQ ID NO: 18(NB5-V4): | $(G/A)_{0-20}$YNE(X)RVAREE$(G/A)_{0-20}$ |
| SEQ ID NO: 19(NB5-V5): | $(G/A)_{0-20}$YNEL(X)VAPEE$(G/A)_{0-20}$ |
| SEQ ID NO: 20(NB5-V6): | $(G/A)_{0-20}$YNELR(X)APEE$(G/A)_{0-20}$ |
| SEQ ID NO: 21(NB5-V7): | $(G/A)_{0-20}$YNELRV(X)PEE$(G/A)_{0-20}$ |
| SEQ ID NO: 22(NB5-V8): | $(G/A)_{0-20}$YNELRVA(X)EE$(G/A)_{0-20}$ |
| SEQ ID NO: 23(NB5-V9): | $(G/A)_{0-20}$YNELRVAP(X)E$(G/A)_{0-20}$ |
| SEQ ID NO: 24(NB5-V10): | $(G/A)_{0-20}$YNELRVAPE(X) $(G/A)_{0-20}$ |
| SEQ ID NO: 25(B5-NV2): | $(X)_{0-20}$WHHTFYNELR$(X)_{0-20}$ |
| SEQ ID NO: 26(B5-NV2): | $(G/A)_{0-20}$W(X)HTFYNELR$(G/A)_{0-20}$ |
| SEQ ID NO: 27(B5-NV3): | $(G/A)_{0-20}$WH(X)TFYNELR$(G/A)_{0-20}$ |

-continued

| ID (Name) | Peptide Sequence (N to C) |
|---|---|
| SEQ ID NO: 28(B5-NV4): | $(G/A)_{0-20}$WHH(X)FYNELR$(G/A)_{0-20}$ |
| SEQ ID NO: 29(B5-NV5): | $(G/A)_{0-20}$WHHT(X)YNELR$(G/A)_{0-20}$ |
| SEQ ID NO: 30(B5-NV6): | $(G/A)_{0-20}$WHHTF(X)NELR$(G/A)_{0-20}$ |
| SEQ ID NO: 31(B5-NV7): | $(G/A)_{0-20}$WHHTFY(X)ELR$(G/A)_{0-20}$ |
| SEQ ID NO: 32(B5-NV8): | $(G/A)_{0-20}$WHHTFYN(X)LR$(G/A)_{0-20}$ |
| SEQ ID NO: 33(B5-NV9): | $(G/A)_{0-20}$WHHTFYNE(X)R$(G/A)_{0-20}$ |
| SEQ ID NO: 34(B5-NV10): | $(G/A)_{0-20}$WHHTFYNEL(X)$(G/A)_{0-20}$ |
| SEQ ID NO: 35(B5-N1): | $(G/A)_{0-20}$VTNWDDMEKI$(G/A)_{0-20}$ |
| SEQ ID NO: 36(B5-N2): | $(G/A)_{0-20}$TNWDDMEKIW$(G/A)_{0-20}$ |
| SEQ ID NO: 37(B5-N3): | $(G/A)_{0-20}$NWDDMEKIWH$(G/A)_{0-20}$ |
| SEQ ID NO: 38(B5-N4): | $(G/A)_{0-20}$WDDMEKIWHH$(G/A)_{0-20}$ |
| SEQ ID NO: 39(B5-N5): | $(G/A)_{0-20}$DDMEKIWHHT$(G/A)_{0-20}$ |
| SEQ ID NO: 40(B5-N6): | $(G/A)_{0-20}$DMEKIWHHTF$(G/A)_{0-20}$ |
| SEQ ID NO: 41(B5-N7): | $(G/A)_{0-20}$MEKIWHHTFY$(G/A)_{0-20}$ |
| SEQ ID NO: 42(B5-N8): | $(G/A)_{0-20}$EKIWHHTFYN$(G/A)_{0-20}$ |
| SEQ ID NO: 43(B5-N9): | $(G/A)_{0-20}$KIWHHTFYNE$(G/A)_{0-20}$ |
| SEQ ID NO: 44(B5-N10): | $(G/A)_{0-20}$IWHHTFYNEL$(G/A)_{0-20}$ |
| SEQ ID NO: 45(B5-N11): | $(G/A)_{0-20}$WHHTFYNELR$(G/A)_{0-20}$ |
| SEQ ID NO: 46(B5-N12): | $(G/A)_{0-20}$HHTFYNELRV$(G/A)_{0-20}$ |
| SEQ ID NO: 47(B5-N13): | $(G/A)_{0-20}$HTFYNELRVA$(G/A)_{0-20}$ |
| SEQ ID NO: 48(B5-N14): | $(G/A)_{0-20}$TFYNELRVAP$(G/A)_{0-20}$ |
| SEQ ID NO: 49(B5-N15): | $(G/A)_{0-20}$FYNELRVAPE$(G/A)_{0-20}$ |
| SEQ ID NO: 50(B5-N16): | $(G/A)_{0-20}$YNELRVAPEE$(G/A)_{0-20}$ |
| SEQ ID NO: 51(B5-N17): | $(G/A)_{0-20}$NELRVAPEEH$(G/A)_{0-20}$ |
| SEQ ID NO: 52(B5-N18): | $(G/A)_{0-20}$ELRVAPEEHP$(G/A)_{0-20}$ |
| SEQ ID NO: 53(B5-N19): | $(G/A)_{0-20}$LRVAPEEHPV$(G/A)_{0-20}$ |
| SEQ ID NO: 54(B5-N20): | $(G/A)_{0-20}$RVAPEEHPVL$(G/A)_{0-20}$ |
| SEQ ID NO: 55(B5-N21): | $(G/A)_{0-20}$VAPEEHPVLL$(G/A)_{0-20}$ |
| SEQ ID NO: 56(B5-N22): | $(G/A)_{0-20}$APEEHPVLLT$(G/A)_{0-20}$ |
| SEQ ID NO: 57(B5-N23): | $(G/A)_{0-20}$PEEHPVLLTE$(G/A)_{0-20}$ |
| SEQ ID NO: 58(B5-N24): | $(G/A)_{0-20}$EEHPVLLTEA$(G/A)_{0-20}$ |
| SEQ ID NO: 59(B5-N25): | $(G/A)_{0-20}$EHPVLLTEAP$(G/A)_{0-20}$ |
| SEQ ID NO: 60(B5-N26): | $(G/A)_{0-20}$HPVLLTEAPL$(G/A)_{0-20}$ |
| SEQ ID NO: 61(B5-N27): | $(G/A)_{0-20}$PVLLTEAPLN$(G/A)_{0-20}$ |
| SEQ ID NO: 62(B5-N28): | $(G/A)_{0-20}$VILTEAPLNP$(G/A)_{0-20}$ |
| SEQ ID NO: 63(B5-N29): | $(G/A)_{0-20}$LLTEAPLNPK$(G/A)_{0-20}$ |
| SEQ ID NO: 64(B5-N30): | $(G/A)_{0-20}$LTEAPLNPKA$(G/A)_{0-20}$ |
| SEQ ID NO: 65(B5-N31): | $(G/A)_{0-20}$TEAPLNPKAN$(G/A)_{0-20}$ |
| SEQ ID NO: 66(B5-M2): | $(G/A)_{0-20}$EHGIVTNWDDMEKIWHHTFY$(G/A)_{0-20}$ |

-continued

| ID (Name) | Peptide Sequence (N to C) |
|---|---|
| SEQ ID NO: 67(B5-M3): | $(G/A)_{0-20}$HGIVTNWDDMEKIWHHTFYN$(G/A)_{0-20}$ |
| SEQ ID NO: 68(B5-M4): | $(G/A)_{0-20}$GIVTNWDDMEKIWHHTFYNE$(G/A)_{0-20}$ |
| SEQ ID NO: 69(B5-M5): | $(G/A)_{0-20}$IVTNWDDMEKIWHHTFYNEL$(G/A)_{0-20}$ |
| SEQ ID NO: 70(B5-M6): | $(G/A)_{0-20}$VTNWDDMEKIWHHTFYNELR$(G/A)_{0-20}$ |
| SEQ ID NO: 71(B5-M7): | $(G/A)_{0-20}$TNWDDMEKIWHHTFYNELRV$(G/A)_{0-20}$ |
| SEQ ID NO: 72(B5-M8): | $(G/A)_{0-20}$NWDDMEKIWHHTFYNELRVA$(G/A)_{0-20}$ |
| SEQ ID NO: 73(B5-M9): | $(G/A)_{0-20}$WDDMEKIWHHTFYNELRVAP$(G/A)_{0-20}$ |
| SEQ ID NO: 74(B5-M10): | $(G/A)_{0-20}$DDMEKIWHHTFYNELRVAPE$(G/A)_{0-20}$ |
| SEQ ID NO: 75(B5 ): | $(G/A)_{0-20}$DMEKIWHHTFYNELRVAPEE$(G/A)_{0-20}$ |
| SEQ ID NO: 76(B5-P1): | $(G/A)_{0-20}$MEKIWHHTFYNELRVAPEEH$(G/A)_{0-20}$ |
| SEQ ID NO: 77(B5-P2): | $(G/A)_{0-20}$EKIWHHTFYNELRVAPEEHP$(G/A)_{0-20}$ |
| SEQ ID NO: 78(B5-P3): | $(G/A)_{0-20}$KIWHHTFYNELRVAPEEHPV$(G/A)_{0-20}$ |
| SEQ ID NO: 79(B5-P4): | $(G/A)_{0-20}$IWHHTFYNELRVAPEEHPVL$(G/A)_{0-20}$ |
| SEQ ID NO: 80(B5-P5): | $(G/A)_{0-20}$WHHTFYNELRVAPEEHPVLL$(G/A)_{0-20}$ |
| SEQ ID NO: 81(B5-P6): | $(G/A)_{0-20}$HHTFYNELRVAPEEHPVLLT$(G/A)_{0-20}$ |
| SEQ ID NO: 82(B5-P7): | $(G/A)_{0-20}$HTFYNELRVAPEEHPVLLTE$(G/A)_{0-20}$ |
| SEQ ID NO: 83(B5-P8): | $(G/A)_{0-20}$TFYNELRVAPEEHPVLLTEA$(G/A)_{0-20}$ |
| SEQ ID NO: 84(B5-P9): | $(G/A)_{0-20}$FYNELRVAPEEHPVLLTEAP$(G/A)_{0-20}$ |
| SEQ ID NO: 85(B5-P10): | $(G/A)_{0-20}$YNELRVAPEEHPVLLTEAPL$(G/A)_{0-20}$ |
| SEQ ID NO: 86(B5-V1): | $(G/A)_{0-20}$(X)MEKIWHHTFYNELRVAPEE$(G/A)_{0-20}$ |
| SEQ ID NO: 87(B5-V2): | $(G/A)_{0-20}$D(X)EKIWHHTFYNELRVAPEE$(G/A)_{0-20}$ |
| SEQ ID NO: 88(B5-V3): | $(G/A)_{0-20}$DM(X)KIWHHTFYNELRVAPEE$(G/A)_{0-20}$ |
| SEQ ID NO: 89(B5-V4): | $(G/A)_{0-20}$DME(X)IWHHTFYNELRVAPEE$(G/A)_{0-20}$ |
| SEQ ID NO: 90(B5-V5): | $(G/A)_{0-20}$DMEK(X)WHHTFYNELRVAPEE$(G/A)_{0-20}$ |
| SEQ ID NO: 91(B5-V6): | $(G/A)_{0-20}$DMEKI(X)HHTFYNELRVAPEE$(G/A)_{0-20}$ |
| SEQ ID NO: 92(B5-V7): | $(G/A)_{0-20}$DMEKIW(X)HTFYNELRVAPEE$(G/A)_{0-20}$ |
| SEQ ID NO: 93(B5-V8): | $(G/A)_{0-20}$DMEKIWH(X)TFYNELRVAPEE$(G/A)_{0-20}$ |
| SEQ ID NO: 94(B5-V9): | $(G/A)_{0-20}$DMEKIWHH(X)FYNELRVAPEE$(G/A)_{0-20}$ |
| SEQ ID NO: 95(B5-V10): | $(G/A)_{0-20}$DMEKIWHHT(X)YNELRVAPEE$(G/A)_{0-20}$ |
| SEQ ID NO: 96(B5-V11): | $(G/A)_{0-20}$DMEKIWHHTF(X)NELRVAPEE$(G/A)_{0-20}$ |
| SEQ ID NO: 97(B5-V12): | $(G/A)_{0-20}$DMEKIWHHTFY(X)ELRVAPEE$(G/A)_{0-20}$ |
| SEQ ID NO: 98(B5-V13): | $(G/A)_{0-20}$DMEKIWHHTFYN(X)LRVAPEE$(G/A)_{0-20}$ |
| SEQ ID NO: 99(B5-X1): | $(G/A)_{0-20}$(X)EHGIVTNWDDMEKIWHHTFYNELRVAPEEHPVLLTEAPL$(G/A)_{0-20}$ |
| SEQ ID NO: 100(B5-X2): | $(G/A)_{0-20}$I(X)HGIVTNWDDMEKIWHHTFYNELRVAPEEHPVLLTEAPL$(G/A)_{0-20}$ |
| SEQ ID NO: 101(B5-X3): | $(G/A)_{0-20}$IE(X)GIVTNWDDMEKIWHHTFYNELRVAPEEHPVLLTEAPL$(G/A)_{0-20}$ |
| SEQ ID NO: 102(B5-X4): | $(G/A)_{0-20}$IEH(X)IVTNWDDMEKIWHHTFYNELRVAPEEHPVLLTEAPL$(G/A)_{0-20}$ |
| SEQ ID NO: 103(B5-X5): | $(G/A)_{0-20}$IEHG(X)VTNWDDMEKIWHHTFYNELRVAPEEHPVLLTEAPL$(G/A)_{0-20}$ |
| SEQ ID NO: 104(B5-X6): | $(G/A)_{0-20}$IEHGI(X)TNWDDMEKIWHHTFYNELRVAPEEHPVLLTEAPL$(G/A)_{0-20}$ |
| SEQ ID NO: 105(B5-X7): | $(G/A)_{0-20}$IEHGIV(X)NWDDMEKIWHHTFYNELRVAPEEHPVLLTEAPL$(G/A)_{0-20}$ |

-continued

| ID (Name) | Peptide Sequence (N to C) |
|---|---|
| SEQ ID NO: 106(B5-X8): | $(G/A)_{0-20}$IEHGIVT(X)WDDMEKIWHHTFYNELRVAPEEHPVLLTEAPL$(G/A)_{0-20}$ |
| SEQ ID NO: 107(B5-X9): | $(G/A)_{0-20}$IEHGIVTN(X)DDMEKIWHHTFYNELRVAPEEHPVLLTEAPL$(G/A)_{0-20}$ |
| SEQ ID NO: 108(B5-X10): | $(G/A)_{0-20}$IEHGIVTNW(X)DMEKIWHHTFYNELRVAPEEHPVLLTEAPL$(G/A)_{0-20}$ |
| SEQ ID NO: 109(B5-X11): | $(G/A)_{0-20}$IEHGIVTNWD(X)MEKIWHHTFYNELRVAPEEHPVLLTEAPL$(G/A)_{0-20}$ |
| SEQ ID NO: 110(B5-X12): | $(G/A)_{0-20}$IEHGIVTNWDD(X)EKIWHHTFYNELRVAPEEHPVLLTEAPL$(G/A)_{0-20}$ |
| SEQ ID NO: 111(B5-X13): | $(G/A)_{0-20}$IEHGIVTNWDDM(X)KIWHHTFYNELRVAPEEHPVLLTEAPL$(G/A)_{0-20}$ |
| SEQ ID NO: 112(B5-X14): | $(G/A)_{0-20}$IEHGIVTNWDDME(X)IWHHTFYNELRVAPEEHPVLLTEAPL$(G/A)_{0-20}$ |
| SEQ ID NO: 113(B5-X15): | $(G/A)_{0-20}$IEHGIVTNWDDMEK(X)WHHTFYNELRVAPEEHPVLLTEAPL$(G/A)_{0-20}$ |
| SEQ ID NO: 114(B5-X16): | $(G/A)_{0-20}$IEHGIVTNWDDMEKI(X)HHTFYNELRVAPEEHPVLLTEAPL$(G/A)_{0-20}$ |
| SEQ ID NO: 115(B5-X17): | $(G/A)_{0-20}$IEHGIVTNWDDMEKIW(X)HTFYNELRVAPEEHPVLLTEAPL$(G/A)_{0-20}$ |
| SEQ ID NO: 116(B5-X18): | $(G/A)_{0-20}$IEHGIVTNWDDMEKIWH(X)TFYNELRVAPEEHPVLLTEAPL$(G/A)_{0-20}$ |
| SEQ ID NO: 117(B5-X19): | $(G/A)_{0-20}$IEHGIVTNWDDMEKIWHH(X)FYNELRVAPEEHPVLLTEAPL$(G/A)_{0-20}$ |
| SEQ ID NO: 118(B5-X20): | $(G/A)_{0-20}$IEHGIVTNWDDMEKIWHHT(X)YNELRVAPEEHPVLLTEAPL$(G/A)_{0-20}$ |
| SEQ ID NO: 119(B5-X21): | $(G/A)_{0-20}$IEHGIVTNWDDMEKIWHHTF(X)NELRVAPEEHPVLLTEAPL$(G/A)_{0-20}$ |
| SEQ ID NO: 120(B5-X22): | $(G/A)_{0-20}$IEHGIVTNWDDMEKIWHHTFY(X)ELRVAPEEHPVLLTEAPL$(G/A)_{0-20}$ |
| SEQ ID NO: 121(B5-X23): | $(G/A)_{0-20}$IEHGIVTNWDDMEKIWHHTFYN(X)LRVAPEEHPVLLTEAPL$(G/A)_{0-20}$ |
| SEQ ID NO: 122(B5-X24): | $(G/A)_{0-20}$IEHGIVTNWDDMEKIWHHTFYNE(X)RVAPEEHPVLLTEAPL$(G/A)_{0-20}$ |
| SEQ ID NO: 123(B5-X25): | $(G/A)_{0-20}$IEHGIVTNWDDMEKIWHHTFYNEL(X)VAPEEHPVLLTEAPL$(G/A)_{0-20}$ |
| SEQ ID NO: 124(B5-X26): | $(G/A)_{0-20}$IEHGIVTNWDDMEKIWHHTFYNELR(X)APEEHPVLLTEAPL$(G/A)_{0-20}$ |
| SEQ ID NO: 125(B5-X27): | $(G/A)_{0-20}$IEHGIVTNWDDMEKIWHHTFYNELRV(X)PEEHPVLLTEAPL$(G/A)_{0-20}$ |
| SEQ ID NO: 126(B5-X28): | $(G/A)_{0-20}$IEHGIVTNWDDMEKIWHHTFYNELRVA(X)EEHPVLLTEAPL$(G/A)_{0-20}$ |
| SEQ ID NO: 127(B5-X29): | $(G/A)_{0-20}$IEHGIVTNWDDMEKIWHHTFYNELRVAP(X)EHPVLLTEAPL$(G/A)_{0-20}$ |
| SEQ ID NO: 128(B5-X30): | $(G/A)_{0-20}$IEHGIVTNWDDMEKIWHHTFYNELRVAPE(X)HPVLLTEAPL$(G/A)_{0-20}$ |
| SEQ ID NO: 129(B5-X31): | $(G/A)_{0-20}$IEHGIVTNWDDMEKIWHHTFYNELRVAPEE(X)PVLLTEAPL$(G/A)_{0-20}$ |
| SEQ ID NO: 130(B5-X32): | $(G/A)_{0-20}$IEHGIVTNWDDMEKIWHHTFYNELRVAPEEH(X)VLLTEAPL$(G/A)_{0-20}$ |
| SEQ ID NO: 131(B5-X33): | $(G/A)_{0-20}$IEHGIVTNWDDMEKIWHHTFYNELRVAPEEHP(X)LLTEAPL$(G/A)_{0-20}$ |
| SEQ ID NO: 132(B5-X34): | $(G/A)_{0-20}$IEHGIVTNWDDMEKIWHHTFYNELRVAPEEHPV(X)LTEAPL$(G/A)_{0-20}$ |
| SEQ ID NO: 133(B5-X35): | $(G/A)_{0-20}$IEHGIVTNWDDMEKIWHHTFYNELRVAPEEHPVL(X)TEAPL$(G/A)_{0-20}$ |
| SEQ ID NO: 134(B5-X36): | $(G/A)_{0-20}$IEHGIVTNWDDMEKIWHHTFYNELRVAPEEHPVLL(X)EAPL$(G/A)_{0-20}$ |
| SEQ ID NO: 135(B5-X37): | $(G/A)_{0-20}$IEHGIVTNWDDMEKIWHHTFYNELRVAPEEHPVLLT(X)APL$(G/A)_{0-20}$ |
| SEQ ID NO: 136(B5-X38): | $(G/A)_{0-20}$IEHGIVTNWDDMEKIWHHTFYNELRVAPEEHPVLLTE(X)PL$(G/A)_{0-20}$ |
| SEQ ID NO: 137(B5-X39): | $(G/A)_{0-20}$IEHGIVTNWDDMEKIWHHTFYNELRVAPEEHPVLLTEA(X)L$(G/A)_{0-20}$ |
| SEQ ID NO: 138(B5-X40): | $(G/A)_{0-20}$IEHGIVTNWDDMEKIWHHTFYNELRVAPEEHPVLLTEAP(X)$(G/A)_{0-20}$ |
| SEQ ID NO: 139(NB7-V1): | $(X)_{0-20}$(X)IMFETFNTP$(X)_{0-20}$ |
| SEQ ID NO: 140(NB7-V2): | $(G/A)_{0-20}$Q(X)MFETFNTP$(G/A)_{0-20}$ |
| SEQ ID NO: 141(NB7-V3): | $(G/A)_{0-20}$QI(X)FETFNTP$(G/A)_{0-20}$ |
| SEQ ID NO: 142(NB7-V4): | $(G/A)_{0-20}$QIM(X)ETFNTP$(G/A)_{0-20}$ |
| SEQ ID NO: 143(NB7-V5): | $(G/A)_{0-20}$QIMF(X)TFNTP$(G/A)_{0-20}$ |
| SEQ ID NO: 144(NB7-V6): | $(G/A)_{0-20}$QIMFE(X)FNTP$(G/A)_{0-20}$ |

-continued

| ID (Name) | Peptide Sequence (N to C) |
|---|---|
| SEQ ID NO: 145(NB7-V7): | $(G/A)_{0-20}$QIMFET(X)NTP$(G/A)_{0-20}$ |
| SEQ ID NO: 146(NB7-V8): | $(G/A)_{0-20}$QIMFETF(X)TP$(G/A)_{0-20}$ |
| SEQ ID NO: 147(NB7-V9): | $(G/A)_{0-20}$QIMFETFN(X)P$(G/A)_{0-20}$ |
| SEQ ID NO: 148(NB7-V10): | $(G/A)_{0-20}$QIMFETFNT(X)$(G/A)_{0-20}$ |
| SEQ ID NO: 149(N7-NX1): | $(X)_{0-20}$TFN(X0)PAMYVA$(X)_{0-20}$ |
| SEQ ID NO: 150(N7-NX1): | $(G/A)_{0-20}$(X)FN(X0)PAMYVA$(G/A)_{0-20}$ |
| SEQ ID NO: 151(N7-NX2): | $(G/A)_{0-20}$T(X)N(X0)PAMYVA$(G/A)_{0-20}$ |
| SEQ ID NO: 152(N7-NX3): | $(G/A)_{0-20}$TF(X)(X0)PAMYVA$(G/A)_{0-20}$ |
| SEQ ID NO: 153(N7-NX4): | $(G/A)_{0-20}$TFN(X0)(X)AMYVA$(G/A)_{0-20}$ |
| SEQ ID NO: 154(N7-NX5): | $(G/A)_{0-20}$TFN(X0)P(X)MYVA$(G/A)_{0-20}$ |
| SEQ ID NO: 155(N7-NX6): | $(G/A)_{0-20}$TFN(X0)PA(X)YVA$(G/A)_{0-20}$ |
| SEQ ID NO: 156(N7-NX7): | $(G/A)_{0-20}$TFN(X0)PAM(X)VA$(G/A)_{0-20}$ |
| SEQ ID NO: 157(N7-NX8): | $(G/A)_{0-20}$TFN(X0)PAMY(X)A$(G/A)_{0-20}$ |
| SEQ ID NO: 158(N7-NX9): | $(G/A)_{0-20}$TFN(X0)PAMYV(X)$(G/A)_{0-20}$ |
| SEQ ID NO: 159(N7-T1): | $(G/A)_{0-20}$TEAPLNPKAN$(G/A)_{0-20}$ |
| SEQ ID NO: 160(N7-T2): | $(G/A)_{0-20}$EAPLNPKANR$(G/A)_{0-20}$ |
| SEQ ID NO: 161(N7-T3): | $(G/A)_{0-20}$APLNPKANRE$(G/A)_{0-20}$ |
| SEQ ID NO: 162(N7-T4): | $(G/A)_{0-20}$PLNPKANREK$(G/A)_{0-20}$ |
| SEQ ID NO: 163(N7-T5): | $(G/A)_{0-20}$LNPKANREKM$(G/A)_{0-20}$ |
| SEQ ID NO: 164(N7-T6): | $(G/A)_{0-20}$NPKANREKMT$(G/A)_{0-20}$ |
| SEQ ID NO: 165(N7-T7): | $(G/A)_{0-20}$PKANREKMTQ$(G/A)_{0-20}$ |
| SEQ ID NO: 166(N7-T8): | $(G/A)_{0-20}$KANREKMTQI$(G/A)_{0-20}$ |
| SEQ ID NO: 167(N7-T9): | $(G/A)_{0-20}$ANREKMTQIM$(G/A)_{0-20}$ |
| SEQ ID NO: 168(N7-T10): | $(G/A)_{0-20}$NREKMTQIMF$(G/A)_{0-20}$ |
| SEQ ID NO: 169(N7-T11): | $(G/A)_{0-20}$REKMTQIMFE$(G/A)_{0-20}$ |
| SEQ ID NO: 170(N7-T12): | $(G/A)_{0-20}$EKMTQIMFET$(G/A)_{0-20}$ |
| SEQ ID NO: 171(N7-T13): | $(G/A)_{0-20}$KMTQIMFETF$(G/A)_{0-20}$ |
| SEQ ID NO: 172(N7-T14): | $(G/A)_{0-20}$MTQIMFETFN$(G/A)_{0-20}$ |
| SEQ ID NO: 173(N7-T15): | $(G/A)_{0-20}$TQIMFETFN(X0)$(G/A)_{0-20}$ |
| SEQ ID NO: 174(N7-T16): | $(G/A)_{0-20}$QIMFETFN(X0)P$(G/A)_{0-20}$ |
| SEQ ID NO: 175(N7-T17): | $(G/A)_{0-20}$IMFETFN(X0)PA$(G/A)_{0-20}$ |
| SEQ ID NO: 176(N7-T18): | $(G/A)_{0-20}$MFETFN(X0)PAM$(G/A)_{0-20}$ |
| SEQ ID NO: 177(N7-T19): | $(G/A)_{0-20}$FETFN(X0)PAMY$(G/A)_{0-20}$ |
| SEQ ID NO: 178(N7-T20): | $(G/A)_{0-20}$ETFN(X0)PAMYV$(G/A)_{0-20}$ |
| SEQ ID NO: 179(N7-T21): | $(G/A)_{0-20}$TFN(X0)PAMYVA$(G/A)_{0-20}$ |
| SEQ ID NO: 180(N7-T22): | $(G/A)_{0-20}$FN(X0)PAMYVAI$(G/A)_{0-20}$ |
| SEQ ID NO: 181(N7-T23): | $(G/A)_{0-20}$N(X0)PAMYVAIQ$(G/A)_{0-20}$ |
| SEQ ID NO: 182(N7-T24): | $(G/A)_{0-20}$(X0)PAMYVAIQA$(G/A)_{0-20}$ |
| SEQ ID NO: 183(N7-T25): | $(G/A)_{0-20}$PAMYVAIQAV$(G/A)_{0-20}$ |

-continued

| ID (Name) | Peptide Sequence (N to C) |
|---|---|
| SEQ ID NO: 184(N7-T26): | $(G/A)_{0-20}$AMYVAIQAVL$(G/A)_{0-20}$ |
| SEQ ID NO: 185(N7-T27): | $(G/A)_{0-20}$MYVAIQAVLS$(G/A)_{0-20}$ |
| SEQ ID NO: 186(N7-T28): | $(G/A)_{0-20}$YVAIQAVLSL$(G/A)_{0-20}$ |
| SEQ ID NO: 187(N7-T29): | $(G/A)_{0-20}$VAIQAVLSLY$(G/A)_{0-20}$ |
| SEQ ID NO: 188(N7-T30): | $(G/A)_{0-20}$AIQAVLSLYA$(G/A)_{0-20}$ |
| SEQ ID NO: 189(N7-T31): | $(G/A)_{0-20}$IQAVLSLYAS$(G/A)_{0-20}$ |
| SEQ ID NO: 190(N7-T32): | $(G/A)_{0-20}$QAVLSLYASG$(G/A)_{0-20}$ |
| SEQ ID NO: 191(N7-M1): | $(G/A)_{0-20}$TEAPLNPKANREKMTQIMFE$(G/A)_{0-20}$ |
| SEQ ID NO: 192(N7-M2): | $(G/A)_{0-20}$EAPLNPKANREKMTQIMFET$(G/A)_{0-20}$ |
| SEQ ID NO: 193(N7-M3): | $(G/A)_{0-20}$APLNPKANREKMTQIMFETF$(G/A)_{0-20}$ |
| SEQ ID NO: 194(N7-M4): | $(G/A)_{0-20}$PLNPKANREKMTQIMFETFN$(G/A)_{0-20}$ |
| SEQ ID NO: 195(N7-M5): | $(G/A)_{0-20}$LNPKANREKMTQIMFETFN(X0)$(G/A)_{0-20}$ |
| SEQ ID NO: 196(N7-M6): | $(G/A)_{0-20}$NPKANREKMTQIMFETFN(X0)P$(G/A)_{0-20}$ |
| SEQ ID NO: 197(N7-M7): | $(G/A)_{0-20}$PKANREKMTQIMFETFN(X0)PA$(G/A)_{0-20}$ |
| SEQ ID NO: 198(N7-M8): | $(G/A)_{0-20}$KANREKMTQIMFETFN(X0)PAM$(G/A)_{0-20}$ |
| SEQ ID NO: 199(N7-M9): | $(G/A)_{0-20}$ANREKMTQIMFETFN(X0)PAMY$(G/A)_{0-20}$ |
| SEQ ID NO: 200(N7-M10): | $(G/A)_{0-20}$NREKMTQIMFETFN(X0)PAMYV$(G/A)_{0-20}$ |
| SEQ ID NO: 201(N7-M11): | $(G/A)_{0-20}$REKMTQIMFETFN(X0)PAMYVA$(G/A)_{0-20}$ |
| SEQ ID NO: 202(N7-M12): | $(G/A)_{0-20}$EKMTQIMFETFN(X0)PAMYVAI$(G/A)_{0-20}$ |
| SEQ ID NO: 203(N7-M13): | $(G/A)_{0-20}$KMTQIMFETFN(X0)PAMYVAIQ$(G/A)_{0-20}$ |
| SEQ ID NO: 204(N7-M14): | $(G/A)_{0-20}$MTQIMFETFN(X0)PAMYVAIQA$(G/A)_{0-20}$ |
| SEQ ID NO: 205(N7-M15): | $(G/A)_{0-20}$TQIMFETFN(X0)PAMYVAIQAV$(G/A)_{0-20}$ |
| SEQ ID NO: 206(N7 ): | $(G/A)_{0-20}$QIMFETFN(X0)PAMYVAIQAVL$(G/A)_{0-20}$ |
| SEQ ID NO: 207(N7-P1): | $(G/A)_{0-20}$IMFETFN(X0)PAMYVAIQAVLS$(G/A)_{0-20}$ |
| SEQ ID NO: 208(N7-P2): | $(G/A)_{0-20}$MFETFN(X0)PAMYVAIQAVLSL$(G/A)_{0-20}$ |
| SEQ ID NO: 209(N7-P3): | $(G/A)_{0-20}$FETFN(X0)PAMYVAIQAVLSLY$(G/A)_{0-20}$ |
| SEQ ID NO: 210(N7-P4): | $(G/A)_{0-20}$ETFN(X0)PAMYVAIQAVLSLYA$(G/A)_{0-20}$ |
| SEQ ID NO: 211(N7-P5): | $(G/A)_{0-20}$TFN(X0)PAMYVAIQAVLSLYAS$(G/A)_{0-20}$ |
| SEQ ID NO: 212(N7-V1): | $(G/A)_{0-20}$(X)QIMFETFN(X0)PAMYVAIQAVL$(G/A)_{0-20}$ |
| SEQ ID NO: 213(N7-V2): | $(G/A)_{0-20}$Q(X)IMFETFN(X0)PAMYVAIQAVL$(G/A)_{0-20}$ |
| SEQ ID NO: 214(N7-V3): | $(G/A)_{0-20}$QI(X)MFETFN(X0)PAMYVAIQAVL$(G/A)_{0-20}$ |
| SEQ ID NO: 215(N7-V4): | $(G/A)_{0-20}$QIM(X)FETFN(X0)PAMYVAIQAVL$(G/A)_{0-20}$ |
| SEQ ID NO: 216(N7-V5): | $(G/A)_{0-20}$QIMF(X)ETFN(X0)PAMYVAIQAVL$(G/A)_{0-20}$ |
| SEQ ID NO: 217(N7-V6): | $(G/A)_{0-20}$QIMFE(X)TFN(X0)PAMYVAIQAVL$(G/A)_{0-20}$ |
| SEQ ID NO: 218(N7-V7): | $(G/A)_{0-20}$QIMFET(X)FN(X0)PAMYVAIQAVL$(G/A)_{0-20}$ |
| SEQ ID NO: 219(N7-V8): | $(G/A)_{0-20}$QIMFETF(X)N(X0)PAMYVAIQAVL$(G/A)_{0-20}$ |
| SEQ ID NO: 220(N7-V9): | $(G/A)_{0-20}$QIMFETFN(X)(X0)PAMYVAIQAVL$(G/A)_{0-20}$ |
| SEQ ID NO: 221(N7-V10): | $(G/A)_{0-20}$QIMFETFN(X0)P(X)AMYVAIQAVL$(G/A)_{0-20}$ |
| SEQ ID NO: 222(N7-V11): | $(G/A)_{0-20}$QIMFETFN(X0)PA(X)MYVAIQAVL$(G/A)_{0-20}$ |

-continued

| ID (Name) | Peptide Sequence (N to C) |
|---|---|
| SEQ ID NO: 223 (N7-V12): | $(G/A)_{0-20}$QIMFETFN(X0)PAM(X)YVAIQAVL$(G/A)_{0-20}$ |
| SEQ ID NO: 224 (N7-V13): | $(G/A)_{0-20}$QIMFETFN(X0)PAMY(X)VAIQAVL$(G/A)_{0-20}$ |
| SEQ ID NO: 225 (N7-V14): | $(G/A)_{0-20}$QIMFETFN(X0)PAMYV(X)AIQAVL$(G/A)_{0-20}$ |
| SEQ ID NO: 226 (N7-V15): | $(G/A)_{0-20}$QIMFETFN(X0)PAMYVA(X)IQAVL$(G/A)_{0-20}$ |
| SEQ ID NO: 227 (N7-V16): | $(G/A)_{0-20}$QIMFETFN(X0)PAMYVAI(X)QAVL$(G/A)_{0-20}$ |
| SEQ ID NO: 228 (N7-V17): | $(G/A)_{0-20}$QIMFETFN(X0)PAMYVAIQ(X)AVL$(G/A)_{0-20}$ |
| SEQ ID NO: 229 (N7-V18): | $(G/A)_{0-20}$QIMFETFN(X0)PAMYVAIQA(X)VL$(G/A)_{0-20}$ |
| SEQ ID NO: 230 (N7-V19): | $(G/A)_{0-20}$QIMFETFN(X0)PAMYVAIQAV(X)L$(G/A)_{0-20}$ |
| SEQ ID NO: 231 (N7-V20): | $(G/A)_{0-20}$QIMFETFN(X0)PAMYVAIQAVL(X)$(G/A)_{0-20}$ |
| SEQ ID NO: 232 (N7-X1): | $(G/A)_{0-20}$(X)PKANREKMTQIMFETFN(X0)PAMYVAIQAVLSLYASGRTTGI$(G/A)_{0-20}$ |
| SEQ ID NO: 233 (N7-X2): | $(G/A)_{0-20}$N(X)KANREKMTQIMFETFN(X0)PAMYVAIQAVLSLYASGRTTGI$(G/A)_{0-20}$ |
| SEQ ID NO: 234 (N7-X3): | $(G/A)_{0-20}$NP(X)ANREKMTQIMFETFN(X0)PAMYVAIQAVLSLYASGRTTGI$(G/A)_{0-20}$ |
| SEQ ID NO: 235 (N7-X4): | $(G/A)_{0-20}$NPK(X)NREKMTQIMFETFN(X0)PAMYVAIQAVLSLYASGRTTGI$(G/A)_{0-20}$ |
| SEQ ID NO: 236 (N7-X5): | $(G/A)_{0-20}$NPKA(X)REKMTQIMFETFN(X0)PAMYVAIQAVLSLYASGRTTGI$(G/A)_{0-20}$ |
| SEQ ID NO: 237 (N7-X6): | $(G/A)_{0-20}$NPKAN(X)EKMTQIMFETFN(X0)PAMYVAIQAVLSLYASGRTTGI$(G/A)_{0-20}$ |
| SEQ ID NO: 238 (N7-X7): | $(G/A)_{0-20}$NPKANR(X)KMTQIMFETFN(X0)PAMYVAIQAVLSLYASGRTTGI$(G/A)_{0-20}$ |
| SEQ ID NO: 239 (N7-X8): | $(G/A)_{0-20}$NPKANRE(X)MTQIMFETFN(X0)PAMYVAIQAVLSLYASGRTTGI$(G/A)_{0-20}$ |
| SEQ ID NO: 240 (N7-X9): | $(G/A)_{0-20}$NPKANREK(X)TQIMFETFN(X0)PAMYVAIQAVLSLYASGRTTGI$(G/A)_{0-20}$ |
| SEQ ID NO: 241 (N7-X10): | $(G/A)_{0-20}$NPKANREKM(X)QIMFETFN(X0)PAMYVAIQAVLSLYASGRTTGI$(G/A)_{0-20}$ |
| SEQ ID NO: 242 (N7-X11): | $(G/A)_{0-20}$NPKANREKMT(X)IMFETFN(X0)PAMYVAIQAVLSLYASGRTTGI$(G/A)_{0-20}$ |
| SEQ ID NO: 243 (N7-X12): | $(G/A)_{0-20}$NPKANREKMTQ(X)MFETFN(X0)PAMYVAIQAVLSLYASGRTTGI$(G/A)_{0-20}$ |
| SEQ ID NO: 244 (N7-X13): | $(G/A)_{0-20}$NPKANREKMTQI(X)FETFN(X0)PAMYVAIQAVLSLYASGRTTGI$(G/A)_{0-20}$ |
| SEQ ID NO: 245 (N7-X14): | $(G/A)_{0-20}$NPKANREKMTQIM(X)ETFN(X0)PAMYVAIQAVLSLYASGRTTGI$(G/A)_{0-20}$ |
| SEQ ID NO: 246 (N7-X15): | $(G/A)_{0-20}$NPKANREKMTQIMF(X)TFN(X0)PAMYVAIQAVLSLYASGRTTGI$(G/A)_{0-20}$ |
| SEQ ID NO: 247 (N7-X16): | $(G/A)_{0-20}$NPKANREKMTQIMFE(X)FN(X0)PAMYVAIQAVLSLYASGRTTGI$(G/A)_{0-20}$ |
| SEQ ID NO: 248 (N7-X17): | $(G/A)_{0-20}$NPKANREKMTQIMFET(X)N(X0)PAMYVAIQAVLSLYASGRTTGI$(G/A)_{0-20}$ |
| SEQ ID NO: 249 (N7-X18): | $(G/A)_{0-20}$NPKANREKMTQIMFETF(X)(X0)PAMYVAIQAVLSLYASGRTTGI$(G/A)_{0-20}$ |
| SEQ ID NO: 250 (N7-X19): | $(G/A)_{0-20}$NPKANREKMTQIMFETFN(X)(X0)AMYVAIQAVLSLYASGRTTGI$(G/A)_{0-20}$ |
| SEQ ID NO: 251 (N7-X20): | $(G/A)_{0-20}$NPKANREKMTQIMFETFN(X)P(X0)MYVAIQAVLSLYASGRTTGI$(G/A)_{0-20}$ |
| SEQ ID NO: 252 (N7-X21): | $(G/A)_{0-20}$NPKANREKMTQIMFETFN(X)PA(X0)YVAIQAVLSLYASGRTTGI$(G/A)_{0-20}$ |
| SEQ ID NO: 253 (N7-X22): | $(G/A)_{0-20}$NPKANREKMTQIMFETFN(X)PAM(X0)VAIQAVLSLYASGRTTGI$(G/A)_{0-20}$ |
| SEQ ID NO: 254 (N7-X23): | $(G/A)_{0-20}$NPKANREKMTQIMFETFN(X)PAMY(X0)AIQAVLSLYASGRTTGI$(G/A)_{0-20}$ |
| SEQ ID NO: 255 (N7-X24): | $(G/A)_{0-20}$NPKANREKMTQIMFETFN(X)PAMYV(X0)IQAVLSLYASGRTTGI$(G/A)_{0-20}$ |
| SEQ ID NO: 256 (N7-X25): | $(G/A)_{0-20}$NPKANREKMTQIMFETFN(X)PAMYVA(X0)QAVLSLYASGRTTGI$(G/A)_{0-20}$ |
| SEQ ID NO: 257 (N7-X26): | $(G/A)_{0-20}$NPKANREKMTQIMFETFN(X)PAMYVAI(X0)AVLSLYASGRTTGI$(G/A)_{0-20}$ |
| SEQ ID NO: 258 (N7-X27): | $(G/A)_{0-20}$NPKANREKMTQIMFETFN(X)PAMYVAIQ(X0)VLSLYASGRTTGI$(G/A)_{0-20}$ |
| SEQ ID NO: 259 (N7-X28): | $(G/A)_{0-20}$NPKANREKMTQIMFETFN(X)PAVYVAIQA(X0)LSLYASGRTTGI$(G/A)_{0-20}$ |
| SEQ ID NO: 260 (N7-X29): | $(G/A)_{0-20}$NPKANREKMTQIMFETFN(X)PAMYVAIQAV(X0)SLYASGRTTGI$(G/A)_{0-20}$ |

-continued

| ID (Name) | Peptide Sequence (N to C) |
|---|---|
| SEQ ID NO: 261(N7-X30): | $(G/A)_{0-20}$NPKANREKMTQIMFETFN(X)PAMYVAIQAVL(X0)LYASGRTTGI$(G/A)_{0-20}$ |
| SEQ ID NO: 262(N7-X31): | $(G/A)_{0-20}$NPKANREKMTQIMFETFN(X)PAMYVAIQAVLS(X0)YASGRTTGI$(G/A)_{0-20}$ |
| SEQ ID NO: 263(N7-X32): | $(G/A)_{0-20}$NPKANREKMTQIMFETFN(X)PAMYVAIQAVLSL(X0)ASGRTTGI$(G/A)_{0-20}$ |
| SEQ ID NO: 264(N7-X33): | $(G/A)_{0-20}$NPKANREKMTQIMFETFN(X)PAMYVAIQAVLSLY(X0)SGRTTGI$(G/A)_{0-20}$ |
| SEQ ID NO: 265(N7-X34): | $(G/A)_{0-20}$NPKANREKMTQIMFETFN(X)PAMYVAIQAVLSLYA(X0)GRTTGI$(G/A)_{0-20}$ |
| SEQ ID NO: 266(N7-X35): | $(G/A)_{0-20}$NPKANREKMTQIMFETFN(X)PAMYVAIQAVLSLYAS(X0)RTTGI$(G/A)_{0-20}$ |
| SEQ ID NO: 267(N7-X36): | $(G/A)_{0-20}$NPKANREKMTQIMFETFN(X)PAMYVAIQAVLSLYASG(X0)TTGI$(G/A)_{0-20}$ |
| SEQ ID NO: 268(N7-X37): | $(G/A)_{0-20}$NPKANREKMTQIMFETFN(X)PAMYVAIQAVLSLYASGR(X0)TGI$(G/A)_{0-20}$ |
| SEQ ID NO: 269(N7-X38): | $(G/A)_{0-20}$NPKANREKMTQIMFETFN(X)PAMYVAIQAVLSLYASGRT(X0)GI$(G/A)_{0-20}$ |
| SEQ ID NO: 270(N7-X39): | $(G/A)_{0-20}$NPKANREKMTQIMFETFN(X)PAMYVAIQAVLSLYASGRTT(X0)I$(G/A)_{0-20}$ |
| SEQ ID NO: 271(N7-X40): | $(G/A)_{0-20}$NPKANREKMTQIMFETFN(X)PAMYVAIQAVLSLYASGRTTG(X0)$(G/A)_{0-20}$ |
| SEQ ID NO: 272(B6-V1): | $(G/A)_{0-20}$(X)PKANREKMTQIMFETFN(X0)P$(G/A)_{0-20}$ |
| SEQ ID NO: 273(B6-V1): | $(G/A)_{0-20}$N(X)KANREKMTQIMFETFN(X0)P$(G/A)_{0-20}$ |
| SEQ ID NO: 274(B6-V1): | $(G/A)_{0-20}$NP(X)ANREKMTQIMFETFN(X0)P$(G/A)_{0-20}$ |
| SEQ ID NO: 275(B6-V1): | $(G/A)_{0-20}$NPK(X)NREKMTQIMFETFN(X0)P$(G/A)_{0-20}$ |
| SEQ ID NO: 276(B6-V1): | $(G/A)_{0-20}$NPKA(X)REKMTQIMFETFN(X0)P$(G/A)_{0-20}$ |
| SEQ ID NO: 277(B6-V1): | $(G/A)_{0-20}$NPKAN(X)EKMTQIMFETFN(X0)P$(G/A)_{0-20}$ |
| SEQ ID NO: 278(B6-V1): | $(G/A)_{0-20}$NPKANR(X)KMTQIMFETFN(X0)P$(G/A)_{0-20}$ |
| SEQ ID NO: 279(B6-V1): | $(G/A)_{0-20}$NPKANRE(X)MTQIMFETFN(X0)P$(G/A)_{0-20}$ |
| SEQ ID NO: 280(B6-V1): | $(G/A)_{0-20}$NPKANREK(X)TQIMFETFN(X0)P$(G/A)_{0-20}$ |
| SEQ ID NO: 281(B6-V1): | $(G/A)_{0-20}$NPKANREKM(X)QIMFETFN(X0)P$(G/A)_{0-20}$ |
| SEQ ID NO: 282(B6-V1): | $(G/A)_{0-20}$NPKANREKMT(X)IMFETFN(X0)P$(G/A)_{0-20}$ |
| SEQ ID NO: 283(B6-V1): | $(G/A)_{0-20}$NPKANREKMTQ(X)MFETFN(X0)P$(G/A)_{0-20}$ |
| SEQ ID NO: 284(B6-V1): | $(G/A)_{0-20}$NPKANREKMTQI(X)FETFN(X0)P$(G/A)_{0-20}$ |
| SEQ ID NO: 285(B6-V1): | $(G/A)_{0-20}$NPKANREKMTQIM(X)ETFN(X0)P$(G/A)_{0-20}$ |
| SEQ ID NO: 286(B6-V1): | $(G/A)_{0-20}$NPKANREKMTQIMF(X)TFN(X0)P$(G/A)_{0-20}$ |
| SEQ ID NO: 287(B6-V1): | $(G/A)_{0-20}$NPKANREKMTQIMFE(X)FN(X0)P$(G/A)_{0-20}$ |
| SEQ ID NO: 288(B6-V1): | $(G/A)_{0-20}$NPKANREKMTQIMFET(X)N(X0)P$(G/A)_{0-20}$ |
| SEQ ID NO: 289(B6-V1): | $(G/A)_{0-20}$NPKANREKMTQIMFETF(X)(X0)P$(G/A)_{0-20}$ |
| SEQ ID NO: 290(B6-V1): | $(G/A)_{0-20}$NPKANREKMTQIMFETFN(X0)(X)$(G/A)_{0-20}$ |
| SEQ ID NO: 291(NB9-core): | $(X)_{0-20}$(X)PHAILRLDL$(X)_{0-20}$ |
| SEQ ID NO: 292(NB9-core): | $(G/A)_{0-20}$L(X)HAILRLDL$(G/A)_{0-20}$ |
| SEQ ID NO: 293(NB9-core): | $(G/A)_{0-20}$LP(X)AILRLDL$(G/A)_{0-20}$ |
| SEQ ID NO: 294(NB9-core): | $(G/A)_{0-20}$LPH(X)ILRLDL$(G/A)_{0-20}$ |
| SEQ ID NO: 295(NB9-core): | $(G/A)_{0-20}$LPHA(X)LRLDL$(G/A)_{0-20}$ |
| SEQ ID NO: 296(NB9-core): | $(G/A)_{0-20}$LPHAI(X)RLDL$(G/A)_{0-20}$ |
| SEQ ID NO: 297(NB9-core): | $(G/A)_{0-20}$LPHAIL(X)LDL$(G/A)_{0-20}$ |
| SEQ ID NO: 298(NB9-core): | $(G/A)_{0-20}$LPHAILRL(X)L$(G/A)_{0-20}$ |
| SEQ ID NO: 299(NB9-core): | $(G/A)_{0-20}$LPHAILRLD(X)$(G/A)_{0-20}$ |

-continued

| ID (Name) | Peptide Sequence (N to C) |
|---|---|
| SEQ ID NO: 300 (N9-NV1): | $(X)_{0-20}(X)YALPHAI(X0)R(X)_{0-20}$ |
| SEQ ID NO: 301 (N9-NV2): | $(G/A)_{0-20}G(X)ALPHAI(X0)R(G/A)_{0-20}$ |
| SEQ ID NO: 302 (N9-NV3): | $(G/A)_{0-20}GY(X)LPHAI(X0)R(G/A)_{0-20}$ |
| SEQ ID NO: 303 (N9-NV4): | $(G/A)_{0-20}GYA(X)PHAI(X0)R(G/A)_{0-20}$ |
| SEQ ID NO: 304 (N9-NV5): | $(G/A)_{0-20}GYAL(X)HAI(X0)R(G/A)_{0-20}$ |
| SEQ ID NO: 305 (N9-NV6): | $(G/A)_{0-20}GYALP(X)AI(X0)R(G/A)_{0-20}$ |
| SEQ ID NO: 306 (N9-NV7): | $(G/A)_{0-20}GYALPH(X)I(X0)R(G/A)_{0-20}$ |
| SEQ ID NO: 307 (N9-NV8): | $(G/A)_{0-20}GYALPHA(X)(X0)R(G/A)_{0-20}$ |
| SEQ ID NO: 308 (N9-NV9): | $(G/A)_{0-20}GYALPHAI(X0)(X)(G/A)_{0-20}$ |
| SEQ ID NO: 309 (N9-N5): | $(G/A)_{0-20}GDGVTH(X0)VPI(G/A)_{0-20}$ |
| SEQ ID NO: 310 (N9-N6): | $(G/A)_{0-20}DGVTH(X0)VPIY(G/A)_{0-20}$ |
| SEQ ID NO: 311 (N9-N7): | $(G/A)_{0-20}GVTH(X0)VPIYE(G/A)_{0-20}$ |
| SEQ ID NO: 312 (N9-N8): | $(G/A)_{0-20}VDH(X0)VPIYEG(G/A)_{0-20}$ |
| SEQ ID NO: 313 (N9-N9): | $(G/A)_{0-20}TH(X0)VPIYEGY(G/A)_{0-20}$ |
| SEQ ID NO: 314 (N9-N10): | $(G/A)_{0-20}H(X0)VPIYEGYA(G/A)_{0-20}$ |
| SEQ ID NO: 315 (N9-N11): | $(G/A)_{0-20}(X0)VPIYEGYAL(G/A)_{0-20}$ |
| SEQ ID NO: 316 (N9-N12): | $(G/A)_{0-20}(X0)PIYEGYALP(G/A)_{0-20}$ |
| SEQ ID NO: 317 (N9-N13): | $(G/A)_{0-20}(X0)IYEGYALPH(G/A)_{0-20}$ |
| SEQ ID NO: 318 (N9-N14): | $(G/A)_{0-20}(X0)YEGYALPHA(G/A)_{0-20}$ |
| SEQ ID NO: 319 (N9-N15): | $(G/A)_{0-20}(X0)EGYALPHAI(G/A)_{0-20}$ |
| SEQ ID NO: 320 (N9-N16): | $(G/A)_{0-20}EGYALPHAI(X0)(G/A)_{0-20}$ |
| SEQ ID NO: 321 (N9-N17): | $(G/A)_{0-20}GYALPHAI(X0)R(G/A)_{0-20}$ |
| SEQ ID NO: 322 (N9-N18): | $(G/A)_{0-20}YALPHAI(X0)RL(G/A)_{0-20}$ |
| SEQ ID NO: 323 (N9-N19): | $(G/A)_{0-20}ALPHAI(X0)RLD(G/A)_{0-20}$ |
| SEQ ID NO: 324 (N9-N20): | $(G/A)_{0-20}LPHAI(X0)RLDL(G/A)_{0-20}$ |
| SEQ ID NO: 325 (N9-N21): | $(G/A)_{0-20}PHAI(X0)RLDLA(G/A)_{0-20}$ |
| SEQ ID NO: 326 (N9-N22): | $(G/A)_{0-20}HAI(X0)RLDLAG(G/A)_{0-20}$ |
| SEQ ID NO: 327 (N9-N23): | $(G/A)_{0-20}AI(X0)RLDLAGR(G/A)_{0-20}$ |
| SEQ ID NO: 328 (N9-N24): | $(G/A)_{0-20}I(X0)RLDLAGRD(G/A)_{0-20}$ |
| SEQ ID NO: 329 (N9-N25): | $(G/A)_{0-20}(X0)RLDLAGRDL(G/A)_{0-20}$ |
| SEQ ID NO: 330 (N9-N26): | $(G/A)_{0-20}LDLAGRDLTD(G/A)_{0-20}$ |
| SEQ ID NO: 331 (N9-N27): | $(G/A)_{0-20}DLAGRDLTDY(G/A)_{0-20}$ |
| SEQ ID NO: 332 (N9-N28): | $(G/A)_{0-20}LAGRDLTDYL(G/A)_{0-20}$ |
| SEQ ID NO: 333 (N9-N29): | $(G/A)_{0-20}AGRDLTDYLM(G/A)_{0-20}$ |
| SEQ ID NO: 334 (N9-N30): | $(G/A)_{0-20}GRDLTDYLMK(G/A)_{0-20}$ |
| SEQ ID NO: 335 (N9-N31): | $(G/A)_{0-20}RDLTDYLMKI(G/A)_{0-20}$ |

-continued

| ID (Name) | Peptide Sequence (N to C) |
|---|---|
| SEQ ID NO: 336(N9-N32): | $(G/A)_{0-20}$DLTDYLMKIL$(G/A)_{0-20}$ |
| SEQ ID NO: 337(N9-N32): | $(G/A)_{0-20}$LTDYLMKILT$(G/A)_{0-20}$ |
| SEQ ID NO: 338(N9-N32): | $(G/A)_{0-20}$TDYLMKILTE$(G/A)_{0-20}$ |
| SEQ ID NO: 339(N9-N32): | $(G/A)_{0-20}$DYLMKILTER$(G/A)_{0-20}$ |
| SEQ ID NO: 340(B9-T28): | $(G/A)_{0-20}$YLMKILTERG$(G/A)_{0-20}$ |
| SEQ ID NO: 341(B9-T29): | $(G/A)_{0-20}$LMKILTERGY$(G/A)_{0-20}$ |
| SEQ ID NO: 342(B9-T30): | $(G/A)_{0-20}$MKILTERGYS$(G/A)_{0-20}$ |
| SEQ ID NO: 343(B9-T31): | $(G/A)_{0-20}$KILTERGYSF$(G/A)_{0-20}$ |
| SEQ ID NO: 344(N9-V1): | $(G/A)_{0-20}$(X)VPIYEGYALPHAI(X0)RLDLAG$(G/A)_{0-20}$ |
| SEQ ID NO: 345(N9-V2): | $(G/A)_{0-20}$(X)PIYEGYALPHAI(X0)RLDLAG$(G/A)_{0-20}$ |
| SEQ ID NO: 346(N9-V3): | $(G/A)_{0-20}$V(X)IYEGYALPHAI(X0)RLDLAG$(G/A)_{0-20}$ |
| SEQ ID NO: 347(N9-V4): | $(G/A)_{0-20}$VP(X)YEGYALPHAI(X0)RLDLAG$(G/A)_{0-20}$ |
| SEQ ID NO: 348(N9-V5): | $(G/A)_{0-20}$VPI(X)EGYALPHAI(X0)RLDLAG$(G/A)_{0-20}$ |
| SEQ ID NO: 349(N9-V6): | $(G/A)_{0-20}$VPIY(X)GYALPHAI(X0)RLDLAG$(G/A)_{0-20}$ |
| SEQ ID NO: 350(N9-V7): | $(G/A)_{0-20}$VPIYE(X)YALPHAI(X0)RLDLAG$(G/A)_{0-20}$ |
| SEQ ID NO: 351(N9-V8): | $(G/A)_{0-20}$VPIYEG(X)ALPHAI(X0)RLDLAG$(G/A)_{0-20}$ |
| SEQ ID NO: 352(N9-V9): | $(G/A)_{0-20}$VPIYEGY(X)LPHAI(X0)RLDLAG$(G/A)_{0-20}$ |
| SEQ ID NO: 353(N9-V10): | $(G/A)_{0-20}$VPIYEGYA(X)PHAI(X0)RLDLAG$(G/A)_{0-20}$ |
| SEQ ID NO: 354(N9-V11): | $(G/A)_{0-20}$VPIYEGYAL(X)HAI(X0)RLDLAG$(G/A)_{0-20}$ |
| SEQ ID NO: 355(N9-V12): | $(G/A)_{0-20}$VPIYEGYALP(X)AI(X0)RLDLAG$(G/A)_{0-20}$ |
| SEQ ID NO: 356(N9-V13): | $(G/A)_{0-20}$VPIYEGYALPH(X)I(X0)RLDLAG$(G/A)_{0-20}$ |
| SEQ ID NO: 357(N9-V14): | $(G/A)_{0-20}$VPIYEGYALPHA(X)(X0)RLDLAG$(G/A)_{0-20}$ |
| SEQ ID NO: 358(N9-V15): | $(G/A)_{0-20}$VPIYEGYALPHAI(X0)(X)LDLAG$(G/A)_{0-20}$ |
| SEQ ID NO: 359(N9-V16): | $(G/A)_{0-20}$VPIYEGYALPHAI(X0)R(X)DLAG$(G/A)_{0-20}$ |
| SEQ ID NO: 360(N9-V17): | $(G/A)_{0-20}$VPIYEGYALPHAI(X0)RL(X)LAG$(G/A)_{0-20}$ |
| SEQ ID NO: 361(N9-V18): | $(G/A)_{0-20}$VPIYEGYALPHAI(X0)RLD(X)AG$(G/A)_{0-20}$ |
| SEQ ID NO: 362(N9-V19): | $(G/A)_{0-20}$VPIYEGYALPHAI(X0)RLDL(X)G$(G/A)_{0-20}$ |
| SEQ ID NO: 363(N9-V20): | $(G/A)_{0-20}$VPIYEGYALPHAI(X0)RLDLA(X)$(G/A)_{0-20}$ |
| SEQ ID NO: 364(B9-V1): | $(G/A)_{0-20}$(X)PHAI(X0)RLDLAGRDLTDYLM$(G/A)_{0-20}$ |
| SEQ ID NO: 365(B9-V2): | $(G/A)_{0-20}$L(X)HAI(X0)RLDLAGRDLTDYLM$(G/A)_{0-20}$ |
| SEQ ID NO: 366(B9-V3): | $(G/A)_{0-20}$LP(X)AI(X0)RLDLAGRDLTDYLM$(G/A)_{0-20}$ |
| SEQ ID NO: 367(B9-V4): | $(G/A)_{0-20}$LPH(X)I(X0)RLDLAGRDLTDYLM$(G/A)_{0-20}$ |
| SEQ ID NO: 368(B9-V5): | $(G/A)_{0-20}$LPHA(X)(X0)RLDLAGRDLTDYLM$(G/A)_{0-20}$ |
| SEQ ID NO: 369(B9-V6): | $(G/A)_{0-20}$LPHAI(X0)(X)LDLAGRDLTDYLM$(G/A)_{0-20}$ |
| SEQ ID NO: 370(B9-V7): | $(G/A)_{0-20}$LPHAI(X0)R(X)DLAGRDLTDYLM$(G/A)_{0-20}$ |
| SEQ ID NO: 371(B9-V8): | $(G/A)_{0-20}$LPHAI(X0)RL(X)LAGRDLTDYLM$(G/A)_{0-20}$ |
| SEQ ID NO: 372(B9-V9): | $(G/A)_{0-20}$LPHAI(X0)RLD(X)AGRDLTDYLM$(G/A)_{0-20}$ |
| SEQ ID NO: 373(B9-V10): | $(G/A)_{0-20}$LPHAI(X0)RLDL(X)GRDLTDYLM$(G/A)_{0-20}$ |
| SEQ ID NO: 374(B9-V11): | $(G/A)_{0-20}$LPHAI(X0)RLDLA(X)RDLTDYLM$(G/A)_{0-20}$ |

-continued

| ID (Name) | Peptide Sequence (N to C) |
|---|---|
| SEQ ID NO: 375(B9-V12): | $(G/A)_{0-20}$LPHAI(X0)RLDLAG(X)DLTDYLM$(G/A)_{0-20}$ |
| SEQ ID NO: 376(B9-V13): | $(G/A)_{0-20}$LPHAI(X0)RLDLAGR(X)LTDYLM$(G/A)_{0-20}$ |
| SEQ ID NO: 377(B9-V14): | $(G/A)_{0-20}$LPHAI(X0)RLDLAGRD(X)TDYLM$(G/A)_{0-20}$ |
| SEQ ID NO: 378(B9-V15): | $(G/A)_{0-20}$LPHAI(X0)RLDLAGRDL(X)DYLM$(G/A)_{0-20}$ |
| SEQ ID NO: 379(B9-V16): | $(G/A)_{0-20}$LPHAI(X0)RLDLAGRDLT(X)YLM$(G/A)_{0-20}$ |
| SEQ ID NO: 380(B9-V17): | $(G/A)_{0-20}$LPHAI(X0)RLDLAGRDLTD(X)LM$(G/A)_{0-20}$ |
| SEQ ID NO: 381(B9-V18): | $(G/A)_{0-20}$LPHAI(X0)RLDLAGRDLTDY(X)M$(G/A)_{0-20}$ |
| SEQ ID NO: 382(B9-V19): | $(G/A)_{0-20}$LPHAI(X0)RLDLAGRDLTDYL(X)$(G/A)_{0-20}$ |
| SEQ ID NO: 383 N9-M1): | $(G/A)_{0-20}$V(X0)DSGDGVTH(X0)VPIYEGYAL$(G/A)_{0-20}$ |
| SEQ ID NO: 384(N9-M2): | $(G/A)_{0-20}$(X0)DSGDGVTH(X0)VPIYEGYALP$(G/A)_{0-20}$ |
| SEQ ID NO: 385(N9-M3): | $(G/A)_{0-20}$DSGDGVTH(X0)VPIYEGYALPH$(G/A)_{0-20}$ |
| SEQ ID NO: 386(N9-M4): | $(G/A)_{0-20}$SGDGVTH(X0)VPIYEGYALPHA$(G/A)_{0-20}$ |
| SEQ ID NO: 387(N9-M5): | $(G/A)_{0-20}$GDGVTH(X0)VPIYEGYALPHAI$(G/A)_{0-20}$ |
| SEQ ID NO: 388(N9-M6): | $(G/A)_{0-20}$DGVTH(X0)VPIYEGYALPHAI(X0)$(G/A)_{0-20}$ |
| SEQ ID NO: 389(N9-M7): | $(G/A)_{0-20}$GVTH(X0)VPIYEGYALPHAI(X0)R$(G/A)_{0-20}$ |
| SEQ ID NO: 390(N9-M8): | $(G/A)_{0-20}$VTH(X0)VPIYEGYALPHAI(X0)RL$(G/A)_{0-20}$ |
| SEQ ID NO: 391(N9-M9): | $(G/A)_{0-20}$TH(X0)VPIYEGYALPHAI(X0)RLD$(G/A)_{0-20}$ |
| SEQ ID NO: 392(N9 ): | $(G/A)_{0-20}$H(X0)VPIYEGYALPHAI(X0)RLDL$(G/A)_{0-20}$ |
| SEQ ID NO: 393(N9-P1): | $(G/A)_{0-20}$(X0)VPIYEGYALPHAI(X0)RLDLA$(G/A)_{0-20}$ |
| SEQ ID NO: 394(N9-P2): | $(G/A)_{0-20}$VPIYEGYALPHAI(X0)RLDLAG$(G/A)_{0-20}$ |
| SEQ ID NO: 395(N9-P3): | $(G/A)_{0-20}$PIYEGYALPHAI(X0)RLDLAGR$(G/A)_{0-20}$ |
| SEQ ID NO: 396(N9-P4): | $(G/A)_{0-20}$IYEGYALPHAI(X0)RLDLAGRD$(G/A)_{0-20}$ |
| SEQ ID NO: 397(N9-P5): | $(G/A)_{0-20}$YEGYALPHAI(X0)RLDLAGRDL$(G/A)_{0-20}$ |
| SEQ ID NO: 398(N9-P6): | $(G/A)_{0-20}$EGYALPHAI(X0)RLDLAGRDLT$(G/A)_{0-20}$ |
| SEQ ID NO: 399(N9-P7): | $(G/A)_{0-20}$GYALPHAI(X0)RLDLAGRDLTD$(G/A)_{0-20}$ |
| SEQ ID NO: 400(N9-P8): | $(G/A)_{0-20}$YALPHAI(X0)RLDLAGRDLTDY$(G/A)_{0-20}$ |
| SEQ ID NO: 401(N9-P9): | $(G/A)_{0-20}$ALPHAI(X0)RLDLAGRDLTDYL$(G/A)_{0-20}$ |
| SEQ ID NO: 402(N9-P10): | $(G/A)_{0-20}$LPHAI(X0)RLDLAGRDLTDYLM$(G/A)_{0-20}$ |
| SEQ ID NO: 403(N9-P11): | $(G/A)_{0-20}$RHAI(X0)RLDLAGRDLTDYLMK$(G/A)_{0-20}$ |
| SEQ ID NO: 404(N9-P12): | $(G/A)_{0-20}$HAI(X0)RLDLAGRDLTDYLMKI$(G/A)_{0-20}$ |
| SEQ ID NO: 405(N9-P13): | $(G/A)_{0-20}$AI(X0)RLDLAGRDLTDYLMKIL$(G/A)_{0-20}$ |
| SEQ ID NO: 406(B9-P04): | $(G/A)_{0-20}$I(X0)RLDLAGRDLTDYLMKILT$(G/A)_{0-20}$ |
| SEQ ID NO: 407(B9-P05): | $(G/A)_{0-20}$(X0)RLDLAGRDLTDYLMKILTE$(G/A)_{0-20}$ |
| SEQ ID NO: 408(B9-P06): | $(G/A)_{0-20}$(X0)LDLAGRDLTDYLMKILTER$(G/A)_{0-20}$ |
| SEQ ID NO: 409(B9-P07): | $(G/A)_{0-20}$(X0)DLAGRDLTDYLMKILTERG$(G/A)_{0-20}$ |
| SEQ ID NO: 410(B9-P08): | $(G/A)_{0-20}$(X0)LAGRDLTDYLMKILTERGY$(G/A)_{0-20}$ |
| SEQ ID NO: 411(B9-P09): | $(G/A)_{0-20}$(X0)AGRDLTDYLMKILTERGYS$(G/A)_{0-20}$ |
| SEQ ID NO: 412(B9-P10): | $(G/A)_{0-20}$(X0)GRDLTDYLMKILTERGYSF$(G/A)_{0-20}$ |
| SEQ ID NO: 413(B9-NV01): | $(G/A)_{0-20}$(X)PHAI(X0)RLDLAGRDLTDYLM$(G/A)_{0-20}$ |

-continued

| ID (Name) | Peptide Sequence (N to C) |
|---|---|
| SEQ ID NO: 414 (B9-NV02): | $(G/A)_{0-20}L(X)HAI(X0)RLDLAGRDLTDYLM(G/A)_{0-20}$ |
| SEQ ID NO: 415 (B9-NV03): | $(G/A)_{0-20}LP(X)AI(X0)RLDLAGRDLTDYLM(G/A)_{0-20}$ |
| SEQ ID NO: 416 (B9-NV04): | $(G/A)_{0-20}LPH(X)I(X0)RLDLAGRDLTDYLM(G/A)_{0-20}$ |
| SEQ ID NO: 417 (B9-NV05): | $(G/A)_{0-20}LPHA(X)(X0)RLDLAGRDLTDYLM(G/A)_{0-20}$ |
| SEQ ID NO: 418 (B9-NV06): | $(G/A)_{0-20}LPHA(X)(X0)RLDLAGRDLTDYLM(G/A)_{0-20}$ |
| SEQ ID NO: 419 (B9-NV07): | $(G/A)_{0-20}LPHAI(X0)(X)LDLAGRDLTDYLM(G/A)_{0-20}$ |
| SEQ ID NO: 420 (B9-NV08): | $(G/A)_{0-20}LPHAI(X0)R(X)DLAGRDLTDYLM(G/A)_{0-20}$ |
| SEQ ID NO: 421 (B9-NV09): | $(G/A)_{0-20}LPHAI(X0)RL(X)LAGRDLTDYLM(G/A)_{0-20}$ |
| SEQ ID NO: 422 (B9-NV10): | $(G/A)_{0-20}LPHAI(X0)RLD(X)AGRDLTDYLM(G/A)_{0-20}$ |
| SEQ ID NO: 423 (B9-NV11): | $(G/A)_{0-20}LPHAI(X0)RLDL(X)GRDLTDYLM(G/A)_{0-20}$ |
| SEQ ID NO: 424 (B9-NV12): | $(G/A)_{0-20}LPHAI(X0)RLDLA(X)RDLTDYLM(G/A)_{0-20}$ |
| SEQ ID NO: 425 (B9-NV13): | $(G/A)_{0-20}LPHAI(X0)RLDLAG(X)DLTDYLM(G/A)_{0-20}$ |
| SEQ ID NO: 426 (B9-NV14): | $(G/A)_{0-20}LPHAI(X0)RLDLAGR(X)LTDYLM(G/A)_{0-20}$ |
| SEQ ID NO: 427 (B9-NV15): | $(G/A)_{0-20}LPHAI(X0)RLDLAGRD(X)TDYLM(G/A)_{0-20}$ |
| SEQ ID NO: 428 (B9-NV16): | $(G/A)_{0-20}LPHAI(X0)RLDLAGRDL(X)DYLM(G/A)_{0-20}$ |
| SEQ ID NO: 429 (B9-NV17): | $(G/A)_{0-20}LPHAI(X0)RLDLAGRDLT(X)YLM(G/A)_{0-20}$ |
| SEQ ID NO: 430 (B9-NV18): | $(G/A)_{0-20}LPHAI(X0)RLDLAGRDLTD(X)LM(G/A)_{0-20}$ |
| SEQ ID NO: 431 (B9-NV19): | $(G/A)_{0-20}LPHAI(X0)RLDLAGRDLTDY(X)M(G/A)_{0-20}$ |
| SEQ ID NO: 432 (B9-NV20): | $(G/A)_{0-20}LPHAI(X0)RLDLAGRDLTDYL(X)(G/A)_{0-20}$ |
| SEQ ID NO: 433 (N9-X1): | $(G/A)_{0-20}(X)(X0)DSGDGVTH(X0)VPIYEGYALPHAI(X0)RLDLAGRDLTDYLMKI(G/A)_{0-20}$ |
| SEQ ID NO: 434 (N9-X2): | $(G/A)_{0-20}V(X0)(X)SGDGVTH(X0)VPIYEGYALPHAI(X0)RLDLAGRDLTDYLMKI(G/A)_{0-20}$ |
| SEQ ID NO: 435 (N9-X3): | $(G/A)_{0-20}V(X0)D(X)GDGVTH(X0)VPIYEGYALPHAI(X0)RLDLAGRDLTDYLMKI(G/A)_{0-20}$ |
| SEQ ID NO: 436 (N9-X4): | $(G/A)_{0-20}V(X0)DS(X)DGVTH(X0)VPIYEGYALPHAI(X0)RLDLAGRDLTDYLMKI(G/A)_{0-20}$ |
| SEQ ID NO: 437 (N9-X5): | $(G/A)_{0-20}V(X0)DSG(X)GVTH(X0)VPIYEGYALPHAI(X0)RLDLAGRDLTDYLMKI(G/A)_{0-20}$ |
| SEQ ID NO: 438 (N9-X6): | $(G/A)_{0-20}V(X0)DSGD(X)VTH(X0)VPIYEGYALPHAI(X0)RLDLAGRDLTDYLMKI(G/A)_{0-20}$ |
| SEQ ID NO: 439 (N9-X7): | $(G/A)_{0-20}V(X0)DSGDG(X)TH(X0)VPIYEGYALPHAI(X0)RLDLAGRDLTDYLMKI(G/A)_{0-20}$ |
| SEQ ID NO: 440 (N9-X8): | $(G/A)_{0-20}V(X0)DSGDGV(X)H(X0)VPIYEGYALPHAI(X0)RLDLAGRDLTDYLMKI(G/A)_{0-20}$ |
| SEQ ID NO: 441 (N9-X9): | $(G/A)_{0-20}V(X0)DSGDGVT(X)(X0)VPIYEGYALPHAI(X0)RLDLAGRDLTDYLMKI(G/A)_{0-20}$ |
| SEQ ID NO: 442 (N9-X10): | $(G/A)_{0-20}V(X0)DSGDGVTH(X0)(X)PIYEGYALPHAI(X0)RLDLAGRDLTDYLMKI(G/A)_{0-20}$ |
| SEQ ID NO: 443 (N9-X11): | $(G/A)_{0-20}V(X0)DSGDGVTH(X0)V(X)IYEGYALPHAI(X0)RLDLAGRDLTDYLMKI(G/A)_{0-20}$ |
| SEQ ID NO: 444 (N9-X12): | $(G/A)_{0-20}V(X0)DSGDGVTH(X0)VP(X)YEGYALPHAI(X0)RLDLAGRDLTDYLMKI(G/A)_{0-20}$ |
| SEQ ID NO: 445 (N9-X13): | $(G/A)_{0-20}V(X0)DSGDGVTH(X0)VPI(X)EGYALPHAI(X0)RLDLAGRDLTDYLMKI(G/A)_{0-20}$ |
| SEQ ID NO: 446 (N9-X14): | $(G/A)_{0-20}V(X0)DSGDGVTH(X0)VPIY(X)GYALPHAI(X0)RLDLAGRDLTDYLMKI(G/A)_{0-20}$ |
| SEQ ID NO: 447 (N9-X15): | $(G/A)_{0-20}V(X0)DSGDGVTH(X0)VPIYE(X)YALPHAI(X0)RLDLAGRDLTDYLMKI(G/A)_{0-20}$ |
| SEQ ID NO: 448 (N9-X16): | $(G/A)_{0-20}V(X0)DSGDGVTH(X0)VPIYEG(X)ALPHAI(X0)RLDLAGRDLTDYLMKI(G/A)_{0-20}$ |
| SEQ ID NO: 449 (N9-X17): | $(G/A)_{0-20}V(X0)DSGDGVTH(X0)VPIYEGY(X)LPHAI(X0)RLDLAGRDLTDYLMKI(G/A)_{0-20}$ |
| SEQ ID NO: 450 (N9-X18): | $(G/A)_{0-20}V(X0)DSGDGVTH(X0)VPIYEGYA(X)PHAI(X0)RLDLAGRDLTDYLMKI(G/A)_{0-20}$ |
| SEQ ID NO: 451 (N9-X19): | $(G/A)_{0-20}V(X0)DSGDGVTH(X0)VPIYEGYAL(X)HAI(X0)RLDLAGRDLTDYLMKI(G/A)_{0-20}$ |
| SEQ ID NO: 452 (N9-X20): | $(G/A)_{0-20}V(X0)DSGDGVTH(X0)VPIYEGYALP(X)AI(X0)RLDLAGRDLTDYLMKI(G/A)_{0-20}$ |

-continued

| ID (Name) | Peptide Sequence (N to C) |
|---|---|
| SEQ ID NO: 453(N9-X21): | $(G/A)_{0-20}$V(X0)DSGDGVTH(X0)VPIYEGYALPH(X)I(X0)RLDLAGRDLTDYLMKI$(G/A)_{0-20}$ |
| SEQ ID NO: 454(N9-X22): | $(G/A)_{0-20}$V(X0)DSGDGVTH(X0)VPIYEGYALPHA(X)(X0)RLDLAGRDLTDYLMKI$(G/A)_{0-20}$ |
| SEQ ID NO: 455(N9-X23): | $(G/A)_{0-20}$V(X0)DSGDGVTH(X0)VPIYEGYALPHAI(X0)(X)LDLAGRDLTDYLMKI$(G/A)_{0-20}$ |
| SEQ ID NO: 456(N9-X24): | $(G/A)_{0-20}$V(X0)DSGDGVTH(X0)VPIYEGYALPHAI(X0)R(X)DLAGRDLTDYLMKI$(G/A)_{0-20}$ |
| SEQ ID NO: 457(N9-X25): | $(G/A)_{0-20}$V(X0)DSGDGVTH(X0)VPIYEGYALPHAI(X0)RL(X)LAGRDLTDYLMKI$(G/A)_{0-20}$ |
| SEQ ID NO: 458(N9-X26): | $(G/A)_{0-20}$V(X0)DSGDGVTH(X0)VPIYEGYALPHAI(X0)RLD(X)AGRDLTDYLMKI$(G/A)_{0-20}$ |
| SEQ ID NO: 459(N9-X27): | $(G/A)_{0-20}$V(X0)DSGDGVTH(X0)VPIYEGYALPHAI(X0)RLDL(X)GRDLTDYLMKI$(G/A)_{0-20}$ |
| SEQ ID NO: 460(N9-X28): | $(G/A)_{0-20}$V(X0)DSGDGVTH(X0)VPIYEGYALPHAI(X0)RLDLA(X)RDLTDYLMKI$(G/A)_{0-20}$ |
| SEQ ID NO: 461(N9-X29): | $(G/A)_{0-20}$V(X0)DSGDGVTH(X0)VPIYEGYALPHAI(X0)RLDLAG(X)DLTDYLMKI$(G/A)_{0-20}$ |
| SEQ ID NO: 462(N9-X30): | $(G/A)_{0-20}$V(X0)DSGDGVTH(X0)VPIYEGYALPHAI(X0)RLDLAGR(X)LTDYLMKI$(G/A)_{0-20}$ |
| SEQ ID NO: 463(N9-X31): | $(G/A)_{0-20}$V(X0)DSGDGVTH(X0)VPIYEGYALPHAI(X0)RLDLAGRD(X)TDYLMKI$(G/A)_{0-20}$ |
| SEQ ID NO: 464(N9-X32): | $(G/A)_{0-20}$V(X0)DSGDGVTH(X0)VPIYEGYALPHAI(X0)RLDLAGRDL(X)DYLMKI$(G/A)_{0-20}$ |
| SEQ ID NO: 465(N9-X33): | $(G/A)_{0-20}$V(X0)DSGDGVTH(X0)VPIYEGYALPHAI(X0)RLDLAGRDLT(X)YLMKI$(G/A)_{0-20}$ |
| SEQ ID NO: 466(N9-X34): | $(G/A)_{0-20}$V(X0)DSGDGVTH(X0)VPIYEGYALPHAI(X0)RLDLAGRDLTD(X)LMKI$(G/A)_{0-20}$ |
| SEQ ID NO: 467(N9-X35): | $(G/A)_{0-20}$V(X0)DSGDGVTH(X0)VPIYEGYALPHAI(X0)RLDLAGRDLTDY(X)MKI$(G/A)_{0-20}$ |
| SEQ ID NO: 468(N9-X36): | $(G/A)_{0-20}$V(X0)DSGDGVTH(X0)VPIYEGYALPHAI(X0)RLDLAGRDLTDYL(X)KI$(G/A)_{0-20}$ |
| SEQ ID NO: 469(N9-X37): | $(G/A)_{0-20}$V(X0)DSGDGVTH(X0)VPIYEGYALPHAI(X0)RLDLAGRDLTDYLM(X)I$(G/A)_{0-20}$ |
| SEQ ID NO: 470(N9-X38): | $(G/A)_{0-20}$V(X0)DSGDGVTH(X0)VPIYEGYALPHAI(X0)RLDLAGRDLTDYLMK(X)$(G/A)_{0-20}$ |
| SEQ ID NO: 471(NB10-core): | $(X)_{0-20}$AGRDLTDYLM$(X)_{0-20}$ |
| SEQ ID NO: 472(NB10-core): | $(G/A)_{0-20}$(X)GRDLTDYLM$(G/A)_{0-20}$ |
| SEQ ID NO: 473(NB10-core): | $(G/A)_{0-20}$A(X)RDLTDYLM$(G/A)_{0-20}$ |
| SEQ ID NO: 474(NB10-core): | $(G/A)_{0-20}$AG(X)DLTDYLM$(G/A)_{0-20}$ |
| SEQ ID NO: 475(NB10-core): | $(G/A)_{0-20}$AGR(X)LTDYLM$(G/A)_{0-20}$ |
| SEQ ID NO: 476(NB10-core): | $(G/A)_{0-20}$AGRD(X)TDYLM$(G/A)_{0-20}$ |
| SEQ ID NO: 477(NB10-core): | $(G/A)_{0-20}$AGRDL(X)DYLM$(G/A)_{0-20}$ |
| SEQ ID NO: 478(NB10-core): | $(G/A)_{0-20}$AGRDLT(X)YLM$(G/A)_{0-20}$ |
| SEQ ID NO: 479(NB10-core): | $(G/A)_{0-20}$AGRDLTD(X)LM$(G/A)_{0-20}$ |
| SEQ ID NO: 480(NB10-core): | $(G/A)_{0-20}$AGRDLTDY(X)M$(G/A)_{0-20}$ |
| SEQ ID NO: 481(NB10-core): | $(G/A)_{0-20}$AGRDLTDYL(X)$(G/A)_{0-20}$ |
| SEQ ID NO: 482(N10-NV1): | $(G/A)_{0-20}$(X)DYLMKILTE$(G/A)_{0-20}$ |
| SEQ ID NO: 483(N10-NV2): | $(G/A)_{0-20}$T(X)YLMKILTE$(G/A)_{0-20}$ |
| SEQ ID NO: 484(N10-NV3): | $(G/A)_{0-20}$TD(X)LMKILTE$(G/A)_{0-20}$ |
| SEQ ID NO: 485(N10-NV4): | $(G/A)_{0-20}$TDY(X)MKILTE$(G/A)_{0-20}$ |
| SEQ ID NO: 486(N10-NV5): | $(G/A)_{0-20}$TDYL(X)KILTE$(G/A)_{0-20}$ |
| SEQ ID NO: 487(N10-NV6): | $(G/A)_{0-20}$TDYLM(X)ILTE$(G/A)_{0-20}$ |
| SEQ ID NO: 488(N10-NV7): | $(G/A)_{0-20}$TDYLMK(X)LTE$(G/A)_{0-20}$ |
| SEQ ID NO: 489(N10-NV8): | $(G/A)_{0-20}$TDYLMKI(X)TE$(G/A)_{0-20}$ |
| SEQ ID NO: 490(N10-NV9): | $(G/A)_{0-20}$TDYLMKIL(X)E$(G/A)_{0-20}$ |
| SEQ ID NO: 491(N10-NV10): | $(G/A)_{0-20}$TDYLMKILT(X)$(G/A)_{0-20}$ |

-continued

| ID (Name) | Peptide Sequence (N to C) |
|---|---|
| SEQ ID NO: 492(N10-N1): | $(G/A)_{0-20}$LPHAI(X0)RLDL$(G/A)_{0-20}$ |
| SEQ ID NO: 493(N10-N2): | $(G/A)_{0-20}$PHAI(X0)RLDLA$(G/A)_{0-20}$ |
| SEQ ID NO: 494(N10-N3): | $(G/A)_{0-20}$HAI(X0)RLDLAG$(G/A)_{0-20}$ |
| SEQ ID NO: 495(N10-N4): | $(G/A)_{0-20}$AI(X0)RLDLAGR$(G/A)_{0-20}$ |
| SEQ ID NO: 496(N10-N5): | $(G/A)_{0-20}$I(X0)RLDLAGRD$(G/A)_{0-20}$ |
| SEQ ID NO: 497(N10-N6): | $(G/A)_{0-20}$(X0)RLDLAGRDL$(G/A)_{0-20}$ |
| SEQ ID NO: 498(N10-N7): | $(G/A)_{0-20}$(X0)LDLAGRDLT$(G/A)_{0-20}$ |
| SEQ ID NO: 499(N10-N8): | $(G/A)_{0-20}$(X0)DLAGRDLTD$(G/A)_{0-20}$ |
| SEQ ID NO: 500(N10-N9): | $(G/A)_{0-20}$(X0)LAGRDLTDY$(G/A)_{0-20}$ |
| SEQ ID NO: 501(N10-N10): | $(G/A)_{0-20}$(X0)AGRDLTDYL$(G/A)_{0-20}$ |
| SEQ ID NO: 502(N10-N11): | $(G/A)_{0-20}$(X0)GRDLTDYLM$(G/A)_{0-20}$ |
| SEQ ID NO: 503(N10-N12): | $(G/A)_{0-20}$(X0)RDLTDYLMK$(G/A)_{0-20}$ |
| SEQ ID NO: 504(N10-N13): | $(G/A)_{0-20}$(X0)DLTDYLMKI$(G/A)_{0-20}$ |
| SEQ ID NO: 505(N10-N14): | $(G/A)_{0-20}$(X0)LTDYLMKIL$(G/A)_{0-20}$ |
| SEQ ID NO: 506(N10-N15): | $(G/A)_{0-20}$(X0)TDYLMKILT$(G/A)_{0-20}$ |
| SEQ ID NO: 507(N10-N16): | $(G/A)_{0-20}$(X0)DYLMKILTE$(G/A)_{0-20}$ |
| SEQ ID NO: 508(N10-N17): | $(G/A)_{0-20}$(X0)YLMKILTER$(G/A)_{0-20}$ |
| SEQ ID NO: 509(N10-N18): | $(G/A)_{0-20}$(X0)LMKILTERG$(G/A)_{0-20}$ |
| SEQ ID NO: 510(N10-N19): | $(G/A)_{0-20}$(X0)MKILTERGY$(G/A)_{0-20}$ |
| SEQ ID NO: 511(N10-N20): | $(G/A)_{0-20}$(X0)KILTERGYS$(G/A)_{0-20}$ |
| SEQ ID NO: 512(N10-N21): | $(G/A)_{0-20}$(X0)ILTERGYSF(X0)TTAEREIVR$(G/A)_{0-20}$ |
| SEQ ID NO: 513(N10-N22): | $(G/A)_{0-20}$ILTERGYSF(X0) $(G/A)_{0-20}$ |
| SEQ ID NO: 514(N10-N23): | $(G/A)_{0-20}$LTERGYSF(X0)T$(G/A)_{0-20}$ |
| SEQ ID NO: 515(N10-N24): | $(G/A)_{0-20}$TERGYSF(X0)TT$(G/A)_{0-20}$ |
| SEQ ID NO: 516(N10-N25): | $(G/A)_{0-20}$ERGYSF(X0)TTA$(G/A)_{0-20}$ |
| SEQ ID NO: 517(N10-N26): | $(G/A)_{0-20}$RGYSF(X0)TTAE$(G/A)_{0-20}$ |
| SEQ ID NO: 518(N10-N27): | $(G/A)_{0-20}$GYSF(X0)TTAER$(G/A)_{0-20}$ |
| SEQ ID NO: 519(N10-N28): | $(G/A)_{0-20}$YSF(X0)TTAERE$(G/A)_{0-20}$ |
| SEQ ID NO: 520(N10-N29): | $(G/A)_{0-20}$SF(X0)TTAEREI$(G/A)_{0-20}$ |
| SEQ ID NO: 521(N10-N30): | $(G/A)_{0-20}$F(X0)TTAEREIV$(G/A)_{0-20}$ |
| SEQ ID NO: 522(N10-N31): | $(G/A)_{0-20}$(X0)TTAEREIVR$(G/A)_{0-20}$ |
| SEQ ID NO: 523(N10-V1): | $(G/A)_{0-20}$(X)GRDLTDYLMKILTERGYSF$(G/A)_{0-20}$ |
| SEQ ID NO: 524(N10-V2): | $(G/A)_{0-20}$A(X)RDLTDYLMKILTERGYSF$(G/A)_{0-20}$ |
| SEQ ID NO: 525(N10-V3): | $(G/A)_{0-20}$AG(X)DLTDYLMKILTERGYSF$(G/A)_{0-20}$ |
| SEQ ID NO: 526(N10-V4): | $(G/A)_{0-20}$AGR(X)LTDYLMKILTERGYSF$(G/A)_{0-20}$ |
| SEQ ID NO: 527(N10-V5): | $(G/A)_{0-20}$AGRD(X)TDYLMKILTERGYSF$(G/A)_{0-20}$ |
| SEQ ID NO: 528(N10-V6): | $(G/A)_{0-20}$AGRDL(X)DYLMKILTERGYSF$(G/A)_{0-20}$ |
| SEQ ID NO: 529(N10-V7): | $(G/A)_{0-20}$AGRDLT(X)YLMKILTERGYSF$(G/A)_{0-20}$ |

-continued

| ID (Name) | Peptide Sequence (N to C) |
|---|---|
| SEQ ID NO: 530(N10-V8): | $(G/A)_{0-20}$AGRDLTD(X)LMKILTERGYSF$(G/A)_{0-20}$ |
| SEQ ID NO: 531(N10-V9): | $(G/A)_{0-20}$AGRDLTDY(X)MKILTERGYSF$(G/A)_{0-20}$ |
| SEQ ID NO: 532(N10-V10): | $(G/A)_{0-20}$AGRDLTDYL(X)KILTERGYSF$(G/A)_{0-20}$ |
| SEQ ID NO: 533(N10-V11): | $(G/A)_{0-20}$AGRDLTDYLM(X)ILTERGYSF$(G/A)_{0-20}$ |
| SEQ ID NO: 534(N10-V12): | $(G/A)_{0-20}$AGRDLTDYLMK(X)LTERGYSF$(G/A)_{0-20}$ |
| SEQ ID NO: 535(N10-V13): | $(G/A)_{0-20}$AGRDLTDYLMKI(X)TERGYSF$(G/A)_{0-20}$ |
| SEQ ID NO: 536(N10-V14): | $(G/A)_{0-20}$AGRDLTDYLMKIL(X)ERGYSF$(G/A)_{0-20}$ |
| SEQ ID NO: 537(N10-V15): | $(G/A)_{0-20}$AGRDLTDYLMKILT(X)RGYSF$(G/A)_{0-20}$ |
| SEQ ID NO: 538(N10-V16): | $(G/A)_{0-20}$AGRDLTDYLMKILTE(X)GYSF$(G/A)_{0-20}$ |
| SEQ ID NO: 539(N10-V17): | $(G/A)_{0-20}$AGRDLTDYLMKILTER(X)YSF$(G/A)_{0-20}$ |
| SEQ ID NO: 540(N10-V18): | $(G/A)_{0-20}$AGRDLTDYLMKILTERG(X)SF$(G/A)_{0-20}$ |
| SEQ ID NO: 541(N10-V19): | $(G/A)_{0-20}$AGRDLTDYLMKILTERGY(X)F$(G/A)_{0-20}$ |
| SEQ ID NO: 542(N10-V20): | $(G/A)_{0-20}$AGRDLTDYLMKILTERGYS(X)$(G/A)_{0-20}$ |
| SEQ ID NO: 543(N10-M1): | $(G/A)_{0-20}$LPHAI(X0)RLDLAGRDLTDYLM$(G/A)_{0-20}$ |
| SEQ ID NO: 544(N10-M2): | $(G/A)_{0-20}$PHAI(X0)RLDLAGRDLTDYLMK$(G/A)_{0-20}$ |
| SEQ ID NO: 545(N10-M3): | $(G/A)_{0-20}$HAI(X0)RLDLAGRDLTDYLMKI$(G/A)_{0-20}$ |
| SEQ ID NO: 546(N10-M4): | $(G/A)_{0-20}$AI(X0)RLDLAGRDLTDYLMKIL$(G/A)_{0-20}$ |
| SEQ ID NO: 547(N10-M5): | $(G/A)_{0-20}$I(X0)RLDLAGRDLTDYLMKILT$(G/A)_{0-20}$ |
| SEQ ID NO: 548(N10-M6): | $(G/A)_{0-20}$(X0)RLDLAGRDLTDYLMKILTE$(G/A)_{0-20}$ |
| SEQ ID NO: 549(N10-M7): | $(G/A)_{0-20}$RLDLAGRDLTDYLMKILTER$(G/A)_{0-20}$ |
| SEQ ID NO: 550(N10-M8): | $(G/A)_{0-20}$LDLAGRDLTDYLMKILTERG$(G/A)_{0-20}$ |
| SEQ ID NO: 551(N10-M9): | $(G/A)_{0-20}$DLAGRDLTDYLMKILTERGY$(G/A)_{0-20}$ |
| SEQ ID NO: 552(N10-M10): | $(G/A)_{0-20}$LAGRDLTDYLMKILTERGYS$(G/A)_{0-20}$ |
| SEQ ID NO: 553(N10 ): | $(G/A)_{0-20}$AGRDLTDYLMKILTERGYSF$(G/A)_{0-20}$ |
| SEQ ID NO: 554(N10-P1): | $(G/A)_{0-20}$GRDLTDYLMKILTERGYSF(X0)$(G/A)_{0-20}$ |
| SEQ ID NO: 555(N10-P2): | $(G/A)_{0-20}$RDLTDYLMKILTERGYSF(X0)T$(G/A)_{0-20}$ |
| SEQ ID NO: 556(N10-P3): | $(G/A)_{0-20}$DLTDYLMKILTERGYSF(X0)TT$(G/A)_{0-20}$ |
| SEQ ID NO: 557(N10-P4): | $(G/A)_{0-20}$LTDYLMKILTERGYSF(X0)TTA$(G/A)_{0-20}$ |
| SEQ ID NO: 558(N10-P5): | $(G/A)_{0-20}$TDYLMKILTERGYSF(X0)TTAE$(G/A)_{0-20}$ |
| SEQ ID NO: 559(N10-P6): | $(G/A)_{0-20}$DYLMKILTERGYSF(X0)TTAER$(G/A)_{0-20}$ |
| SEQ ID NO: 560(N10-P7): | $(G/A)_{0-20}$YLMKILTERGYSF(X0)TTAERE$(G/A)_{0-20}$ |
| SEQ ID NO: 561(N10-P8): | $(G/A)_{0-20}$LMKILTERGYSF(X0)TTAEREI$(G/A)_{0-20}$ |
| SEQ ID NO: 562(N10-P9): | $(G/A)_{0-20}$MKILTERGYSF(X0)TTAEREIV$(G/A)_{0-20}$ |
| SEQ ID NO: 563(N10-P10): | $(G/A)_{0-20}$KILTERGYSF(X0)TTAEREIVR$(G/A)_{0-20}$ |
| SEQ ID NO: 564(N10-X1): | $(G/A)_{0-20}$(X)PHAI(X0)RLDLAGRDLTDYLMKILTERGYSF(X0)TTAEREIVR$(G/A)_{0-20}$ |
| SEQ ID NO: 565(N10-X2): | $(G/A)_{0-20}$L(X)HAI(X0)RLDLAGRDLTDYLMKILTERGYSF(X0)TTAEREIVR$(G/A)_{0-20}$ |
| SEQ ID NO: 566(N10-X3): | $(G/A)_{0-20}$LP(X)AI(X0)RLDLAGRDLTDYLMKILTERGYSF(X0)TTAEREIVR$(G/A)_{0-20}$ |
| SEQ ID NO: 567(N10-X4): | $(G/A)_{0-20}$LPH(X)I(X0)RLDLAGRDLTDYLMKILTERGYSF(X0)TTAEREIVR$(G/A)_{0-20}$ |
| SEQ ID NO: 568(N10-X5): | $(G/A)_{0-20}$LPHA(X)(X0)RLDLAGRDLTDYLMKILTERGYSF(X0)TTAEREIVR$(G/A)_{0-20}$ |

-continued

| ID (Name) | Peptide Sequence (N to C) |
|---|---|
| SEQ ID NO: 569(N10-X6): | (G/A)$_{0-20}$LPHAI(X0)(X)LDLAGRDLTDYLMKILTERGYSF(X0)TTAEREIVR(G/A)$_{0-20}$ |
| SEQ ID NO: 570(N10-X7): | (G/A)$_{0-20}$LPHAI(X0)R(X)DLAGRDLTDYLMKILTERGYSF(X0)TTAEREIVR(G/A)$_{0-20}$ |
| SEQ ID NO: 571(N10-X8): | (G/A)$_{0-20}$LPHAI(X0)RL(X)LAGRDLTDYLMKILTERGYSF(X0)TTAEREIVR(G/A)$_{0-20}$ |
| SEQ ID NO: 572(N10-X9): | (G/A)$_{0-20}$LPHAI(X0)RLD(X)AGRDLTDYLMKILTERGYSF(X0)TTAEREIVR(G/A)$_{0-20}$ |
| SEQ ID NO: 573(N10-X10): | (G/A)$_{0-20}$LPHAI(X0)RLDL(X)GRDLTDYLMKILTERGYSF(X0)TTAEREIVR(G/A)$_{0-20}$ |
| SEQ ID NO: 574(N10-X11): | (G/A)$_{0-20}$LPHAI(X0)RLDLA(X)RDLTDYLMKILTERGYSF(X0)TTAEREIVR(G/A)$_{0-20}$ |
| SEQ ID NO: 575(N10-X12): | (G/A)$_{0-20}$LPHAI(X0)RLDLAG(X)DLTDYLMKILTERGYSF(X0)TTAEREIVR(G/A)$_{0-20}$ |
| SEQ ID NO: 576(N10-X13): | (G/A)$_{0-20}$LPHAI(X0)RLDLAGR(X)LTDYLMKILTERGYSF(X0)TTAEREIVR(G/A)$_{0-20}$ |
| SEQ ID NO: 577(N10-X14): | (G/A)$_{0-20}$LPHAI(X0)RLDLAGRD(X)TDYLMKILTERGYSF(X0)TTAEREIVR(G/A)$_{0-20}$ |
| SEQ ID NO: 578(N10-X15): | (G/A)$_{0-20}$LPHAI(X0)RLDLAGRDL(X)DYLMKILTERGYSF(X0)TTAEREIVR(G/A)$_{0-20}$ |
| SEQ ID NO: 579(N10-X16): | (G/A)$_{0-20}$LPHAI(X0)RLDLAGRDLT(X)YLMKILTERGYSF(X0)TTAEREIVR(G/A)$_{0-20}$ |
| SEQ ID NO: 580(N10-X17): | (G/A)$_{0-20}$LPHAI(X0)RLDLAGRDLTD(X)LMKILTERGYSF(X0)TTAEREIVR(G/A)$_{0-20}$ |
| SEQ ID NO: 581(N10-X18): | (G/A)$_{0-20}$LPHAI(X0)RLDLAGRDLTDY(X)MKILTERGYSF(X0)TTAEREIVR(G/A)$_{0-20}$ |
| SEQ ID NO: 582(N10-X19): | (G/A)$_{0-20}$LPHAI(X0)RLDLAGRDLTDYL(X)KILTERGYSF(X0)TTAEREIVR(G/A)$_{0-20}$ |
| SEQ ID NO: 583(N10-X20): | (G/A)$_{0-20}$LPHAI(X0)RLDLAGRDLTDYLM(X)ILTERGYSF(X0)TTAEREIVR(G/A)$_{0-20}$ |
| SEQ ID NO: 584(N10-X21): | (G/A)$_{0-20}$LPHAI(X0)RLDLAGRDLTDYLMK(X)LTERGYSF(X0)TTAEREIVR(G/A)$_{0-20}$ |
| SEQ ID NO: 585(N10-X22): | (G/A)$_{0-20}$LPHAI(X0)RLDLAGRDLTDYLMKI(X)TERGYSF(X0)TTAEREIVR(G/A)$_{0-20}$ |
| SEQ ID NO: 586(N10-X23): | (G/A)$_{0-20}$LPHAI(X0)RLDLAGRDLTDYLMKIL(X)ERGYSF(X0)TTAEREIVR(G/A)$_{0-20}$ |
| SEQ ID NO: 587(N10-X24): | (G/A)$_{0-20}$LPHAI(X0)RLDLAGRDLTDYLMKILT(X)RGYSF(X0)TTAEREIVR(G/A)$_{0-20}$ |
| SEQ ID NO: 588(N10-X25): | (G/A)$_{0-20}$LPHAI(X0)RLDLAGRDLTDYLMKILTE(X)GYSF(X0)TTAEREIVR(G/A)$_{0-20}$ |
| SEQ ID NO: 589(N10-X26): | (G/A)$_{0-20}$LPHAI(X0)RLDLAGRDLTDYLMKILTER(X)YSF(X0)TTAEREIVR(G/A)$_{0-20}$ |
| SEQ ID NO: 590(N10-X27): | (G/A)$_{0-20}$LPHAI(X0)RLDLAGRDLTDYLMKILTERG(X)SF(X0)TTAEREIVR(G/A)$_{0-20}$ |
| SEQ ID NO: 591(N10-X28): | (G/A)$_{0-20}$LPHAI(X0)RLDLAGRDLTDYLMKILTERGY(X)F(X0)TTAEREIVR(G/A)$_{0-20}$ |
| SEQ ID NO: 592(N10-X29): | (G/A)$_{0-20}$LPHAI(X0)RLDLAGRDLTDYLMKILTERGYS(X)(X0)TTAEREIVR(G/A)$_{0-20}$ |
| SEQ ID NO: 593(N10-X30): | (G/A)$_{0-20}$LPHAI(X0)RLDLAGRDLTDYLMKILTERGYSF(X0)(X)TAEREIVR(G/A)$_{0-20}$ |
| SEQ ID NO: 594(N10-X31): | (G/A)$_{0-20}$LPHAI(X0)RLDLAGRDLTDYLMKILTERGYSF(X0)T(X)AEREIVR(G/A)$_{0-20}$ |
| SEQ ID NO: 595(N10-X32): | (G/A)$_{0-20}$LPHAI(X0)RLDLAGRDLTDYLMKILTERGYSF(X0)TT(X)EREIVR(G/A)$_{0-20}$ |
| SEQ ID NO: 596(N10-X33): | (G/A)$_{0-20}$LPHAI(X0)RLDLAGRDLTDYLMKILTERGYSF(X0)TTA(X)REIVR(G/A)$_{0-20}$ |
| SEQ ID NO: 597(N10-X34): | (G/A)$_{0-20}$LPHAI(X0)RLDLAGRDLTDYLMKILTERGYSF(X0)TTAE(X)EIVR(G/A)$_{0-20}$ |
| SEQ ID NO: 598(N10-X35): | (G/A)$_{0-20}$LPHAI(X0)RLDLAGRDLTDYLMKILTERGYSF(X0)TTAER(X)IVR(G/A)$_{0-20}$ |
| SEQ ID NO: 599(N10-X36): | (G/A)$_{0-20}$LPHAI(X0)RLDLAGRDLTDYLMKILTERGYSF(X0)TTAERE(X)VR(G/A)$_{0-20}$ |
| SEQ ID NO: 600(N10-X37): | (G/A)$_{0-20}$LPHAI(X0)RLDLAGRDLTDYLMKILTERGYSF(X0)TTAEREI(X)R(G/A)$_{0-20}$ |
| SEQ ID NO: 601(N10-X38): | (G/A)$_{0-20}$LPHAI(X0)RLDLAGRDLTDYLMKILTERGYSF(X0)TTAEREIV(X)(G/A)$_{0-20}$ |
| SEQ ID NO: 602(B11-core): | (X)$_{0-20}$LCYVALDFEQ(X)$_{0-20}$ |
| SEQ ID NO: 603(B11-NV01): | (G/A)$_{0-20}$(X)CYVALDFE(X0)(G/A)$_{0-20}$ |
| SEQ ID NO: 604(B11-NV02): | (G/A)$_{0-20}$L(X)YVALDFE(X0)(G/A)$_{0-20}$ |
| SEQ ID NO: 605(B11-NV03): | (G/A)$_{0-20}$LC(X)VALDFE(X0)(G/A)$_{0-20}$ |
| SEQ ID NO: 606(B11-NV04): | (G/A)$_{0-20}$LCY(X)ALDFE(X0)(G/A)$_{0-20}$ |
| SEQ ID NO: 607(B11-NV05): | (G/A)$_{0-20}$LCYV(X)LDFE(X0)(G/A)$_{0-20}$ |

-continued

| ID (Name) | Peptide Sequence (N to C) |
|---|---|
| SEQ ID NO: 608(B11-NV06): | $(G/A)_{0-20}$LCYVA(X)DFE(X0)$(G/A)_{0-20}$ |
| SEQ ID NO: 609(B11-NV07): | $(G/A)_{0-20}$LCYVAL(X)FE(X0)$(G/A)_{0-20}$ |
| SEQ ID NO: 610(B11-NV08): | $(G/A)_{0-20}$LCYVALD(X)E(X0)$(G/A)_{0-20}$ |
| SEQ ID NO: 611(B11-NV09): | $(G/A)_{0-20}$LCYVALDF(X)(X0)$(G/A)_{0-20}$ |
| SEQ ID NO: 612(B11-T01): | $(G/A)_{0-20}$F(X0)TTAEREIV$(G/A)_{0-20}$ |
| SEQ ID NO: 613(B11-T02): | $(G/A)_{0-20}$(X0)TTAEREIVR$(G/A)_{0-20}$ |
| SEQ ID NO: 614(B11-T03): | $(G/A)_{0-20}$(X0)TAEREIVRD$(G/A)_{0-20}$ |
| SEQ ID NO: 615(B11-T04): | $(G/A)_{0-20}$(X0)AEREIVRDI$(G/A)_{0-20}$ |
| SEQ ID NO: 616(B11-T05): | $(G/A)_{0-20}$(X0)EREIVRDIK$(G/A)_{0-20}$ |
| SEQ ID NO: 617(B11-T06): | $(G/A)_{0-20}$(X0)REIVRDIKE$(G/A)_{0-20}$ |
| SEQ ID NO: 618(B11-T07): | $(G/A)_{0-20}$(X0)EIVRDIKEK$(G/A)_{0-20}$ |
| SEQ ID NO: 619(B11-T08): | $(G/A)_{0-20}$(X0)IVRDIKEKL$(G/A)_{0-20}$ |
| SEQ ID NO: 620(B11-T09): | $(G/A)_{0-20}$(X0)VRDIKEKLC$(G/A)_{0-20}$ |
| SEQ ID NO: 621(B11-T10): | $(G/A)_{0-20}$(X0)RDIKEKLCY$(G/A)_{0-20}$ |
| SEQ ID NO: 622(B11-T11): | $(G/A)_{0-20}$(X0)DIKEKLCYV$(G/A)_{0-20}$ |
| SEQ ID NO: 623(B11-T12): | $(G/A)_{0-20}$(X0)IKEKLCYVA$(G/A)_{0-20}$ |
| SEQ ID NO: 624(B11-T13): | $(G/A)_{0-20}$(X0)KEKLCYVAL$(G/A)_{0-20}$ |
| SEQ ID NO: 625(B11-T14): | $(G/A)_{0-20}$(X0)EKLCYVALD$(G/A)_{0-20}$ |
| SEQ ID NO: 626(B11-T15): | $(G/A)_{0-20}$(X0)KLCYVALDF$(G/A)_{0-20}$ |
| SEQ ID NO: 627(B11-T16): | $(G/A)_{0-20}$(X0)LCYVALDFE$(G/A)_{0-20}$ |
| SEQ ID NO: 628(B11-T17): | $(G/A)_{0-20}$LCYVALDFE(X0)$(G/A)_{0-20}$ |
| SEQ ID NO: 629(B11-T18): | $(G/A)_{0-20}$CYVALDFE(X0)E$(G/A)_{0-20}$ |
| SEQ ID NO: 630(B11-T19): | $(G/A)_{0-20}$YVALDFE(X0)EM$(G/A)_{0-20}$ |
| SEQ ID NO: 631(B11-T20): | $(G/A)_{0-20}$VALDFE(X0)EMA$(G/A)_{0-20}$ |
| SEQ ID NO: 632(B11-T21): | $(G/A)_{0-20}$ALDFE(X0)EMAT$(G/A)_{0-20}$ |
| SEQ ID NO: 633(B11-T22): | $(G/A)_{0-20}$LDFE(X0)EMATA$(G/A)_{0-20}$ |
| SEQ ID NO: 634(B11-T23): | $(G/A)_{0-20}$DFE(X0)EMATAA$(G/A)_{0-20}$ |
| SEQ ID NO: 635(B11-T24): | $(G/A)_{0-20}$FE(X0)EMATAAS$(G/A)_{0-20}$ |
| SEQ ID NO: 636(B11-T25): | $(G/A)_{0-20}$E(X0)EMATAASS$(G/A)_{0-20}$ |
| SEQ ID NO: 637(B11-T26): | $(G/A)_{0-20}$(X0)EMATAASSS$(G/A)_{0-20}$ |
| SEQ ID NO: 638(B11-T27): | $(G/A)_{0-20}$(X0)MATAASSSS$(G/A)_{0-20}$ |
| SEQ ID NO: 639(B11-T28): | $(G/A)_{0-20}$(X0)ATAASSSSL$(G/A)_{0-20}$ |
| SEQ ID NO: 640(B11-T29): | $(G/A)_{0-20}$(X0)TAASSSSLE$(G/A)_{0-20}$ |
| SEQ ID NO: 641(B11-T30): | $(G/A)_{0-20}$(X0)AASSSSLEK$(G/A)_{0-20}$ |
| SEQ ID NO: 642(B11-T31): | $(G/A)_{0-20}$(X0)ASSSSLEKS$(G/A)_{0-20}$ |
| SEQ ID NO: 643(B11-T32): | $(G/A)_{0-20}$(X0)SSSSLEKSY$(G/A)_{0-20}$ |
| SEQ ID NO: 644(B11-M01): | $(G/A)_{0-20}$F(X0)TTAEREIVRDIKEKLCYV$(G/A)_{0-20}$ |
| SEQ ID NO: 645(B11-M02): | $(G/A)_{0-20}$(X0)TTAEREIVRDIKEKLCYVA$(G/A)_{0-20}$ |
| SEQ ID NO: 646(B11-M03): | $(G/A)_{0-20}$(X0)TAEREIVRDIKEKLCYVAL$(G/A)_{0-20}$ |

-continued

| ID (Name) | Peptide Sequence (N to C) |
|---|---|
| SEQ ID NO: 647(B11-M04): | $(G/A)_{0-20}(X0)$AEREIVRDIKEKLCYVALD$(G/A)_{0-20}$ |
| SEQ ID NO: 648(B11-M05): | $(G/A)_{0-20}(X0)$EREIVRDIKEKLCYVALDF$(G/A)_{0-20}$ |
| SEQ ID NO: 649(B11-M06): | $(G/A)_{0-20}(X0)$REIVRDIKEKLCYVALDFE$(G/A)_{0-20}$ |
| SEQ ID NO: 650(B11-M07): | $(G/A)_{0-20}$EIVRDIKEKLCYVALDFE(X0)$(G/A)_{0-20}$ |
| SEQ ID NO: 651(B11-M08): | $(G/A)_{0-20}$IVRDIKEKLCYVALDFE(X0)EM$(G/A)_{0-20}$ |
| SEQ ID NO: 652(B11-M09): | $(G/A)_{0-20}$VRDIKEKLCYVALDFE(X0)EMA$(G/A)_{0-20}$ |
| SEQ ID NO: 653(B11-M10): | $(G/A)_{0-20}$RDIKEKLCYVALDFE(X0)EMAT$(G/A)_{0-20}$ |
| SEQ ID NO: 654(B11 ): | $(G/A)_{0-20}$DIKEKLCYVALDFE(X0)EMATA$(G/A)_{0-20}$ |
| SEQ ID NO: 655(B11-P01): | $(G/A)_{0-20}$IKEKLCYVALDFE(X0)EMATAA$(G/A)_{0-20}$ |
| SEQ ID NO: 656(B11-P02): | $(G/A)_{0-20}$KEKLCYVALDFE(X0)EMATAAS$(G/A)_{0-20}$ |
| SEQ ID NO: 657(B11-P03): | $(G/A)_{0-20}$EKLCYVALDFE(X0)EMATAASS$(G/A)_{0-20}$ |
| SEQ ID NO: 658(B11-P04): | $(G/A)_{0-20}$KLCYVALDFE(X0)EMATAASSS$(G/A)_{0-20}$ |
| SEQ ID NO: 659(B11-P05): | $(G/A)_{0-20}$LCYVALDFE(X0)EMATAASSSS$(G/A)_{0-20}$ |
| SEQ ID NO: 660(B11-P06): | $(G/A)_{0-20}$CYVALDFE(X0)EMATAASSSSL$(G/A)_{0-20}$ |
| SEQ ID NO: 661(B11-P07): | $(G/A)_{0-20}$YVALDFE(X0)EMATAASSSSLE$(G/A)_{0-20}$ |
| SEQ ID NO: 662(B11-P08): | $(G/A)_{0-20}$VALDFE(X0)EMATAASSSSLEK$(G/A)_{0-20}$ |
| SEQ ID NO: 663(B11-P09): | $(G/A)_{0-20}$ALDFE(X0)EMATAASSSSLEKS$(G/A)_{0-20}$ |
| SEQ ID NO: 664(B11-P10): | $(G/A)_{0-20}$LDFE(X0)EMATAASSSSLEKSY$(G/A)_{0-20}$ |
| SEQ ID NO: 665(B11-P11): | $(G/A)_{0-20}$DFE(X0)EMATAASSSSLEKSYE$(G/A)_{0-20}$ |
| SEQ ID NO: 666(B11-V01): | $(G/A)_{0-20}(X)$IKEKLCYVALDFE(X0)EMATA$(G/A)_{0-20}$ |
| SEQ ID NO: 667(B11-V02): | $(G/A)_{0-20}$D(X)KEKLCYVALDFE(X0)EMATA$(G/A)_{0-20}$ |
| SEQ ID NO: 668(B11-V03): | $(G/A)_{0-20}$DI(X)EKLCYVALDFE(X0)EMATA$(G/A)_{0-20}$ |
| SEQ ID NO: 669(B11-V04): | $(G/A)_{0-20}$DIK(X)KLCYVALDFE(X0)EMATA$(G/A)_{0-20}$ |
| SEQ ID NO: 670(B11-V05): | $(G/A)_{0-20}$DIKE(X)LCYVALDFE(X0)EMATA$(G/A)_{0-20}$ |
| SEQ ID NO: 671(B11-V06): | $(G/A)_{0-20}$DIKEK(X)CYVALDFE(X0)EMATA$(G/A)_{0-20}$ |
| SEQ ID NO: 672(B11-V07): | $(G/A)_{0-20}$DIKEKL(X)YVALDFE(X0)EMATA$(G/A)_{0-20}$ |
| SEQ ID NO: 673(B11-V08): | $(G/A)_{0-20}$DIKEKLC(X)VALDFE(X0)EMATA$(G/A)_{0-20}$ |
| SEQ ID NO: 674(B11-V09): | $(G/A)_{0-20}$DIKEKLCY(X)ALDFE(X0)EMATA$(G/A)_{0-20}$ |
| SEQ ID NO: 675(B11-V10): | $(G/A)_{0-20}$DIKEKLCYV(X)LDFE(X0)EMATA$(G/A)_{0-20}$ |
| SEQ ID NO: 676(B11-V11): | $(G/A)_{0-20}$DIKEKLCYVA(X)DFE(X0)EMATA$(G/A)_{0-20}$ |
| SEQ ID NO: 677(B11-V12): | $(G/A)_{0-20}$DIKEKLCYVAL(X)FE(X0)EMATA$(G/A)_{0-20}$ |
| SEQ ID NO: 678(B11-V13): | $(G/A)_{0-20}$DIKEKLCYVALD(X)E(X0)EMATA$(G/A)_{0-20}$ |
| SEQ ID NO: 679(B11-V14): | $(G/A)_{0-20}$DIKEKLCYVALDF(X)(X0)EMATA$(G/A)_{0-20}$ |
| SEQ ID NO: 680(B11-V15): | $(G/A)_{0-20}$DIKEKLCYVALDFE(X0)(X)MATA$(G/A)_{0-20}$ |
| SEQ ID NO: 681(B11-V16): | $(G/A)_{0-20}$DIKEKLCYVALDFE(X0)E(X)ATA$(G/A)_{0-20}$ |
| SEQ ID NO: 682(B11-V17): | $(G/A)_{0-20}$DIKEKLCYVALDFE(X0)EM(X)TA$(G/A)_{0-20}$ |
| SEQ ID NO: 683(B11-V18): | $(G/A)_{0-20}$DIKEKLCYVALDFE(X0)EMA(X)A$(G/A)_{0-20}$ |
| SEQ ID NO: 684(B11-V19): | $(G/A)_{0-20}$DIKEKLCYVALDFE(X0)EMAT(X)$(G/A)_{0-20}$ |
| SEQ ID NO: 685(B11-X01): | $(G/A)_{0-20}(X)(X0)$TTAEREIVRDIKEKLCYVALDFE(X0)EMATAASSSSLEKSY$(G/A)_{0-20}$ |

-continued

| ID (Name) | Peptide Sequence (N to C) |
|---|---|
| SEQ ID NO: 686(B11-X02): | (G/A)$_{0-20}$F(X0)(X)TAEREIVRDIKEKLCYVALDFE(X0)EMATAASSSSLEKSY(G/A)$_{0-20}$ |
| SEQ ID NO: 687(B11-X03): | (G/A)$_{0-20}$F(X0)T(X)AEREIVRDIKEKLCYVALDFE(X0)EMATAASSSSLEKSY(G/A)$_{0-20}$ |
| SEQ ID NO: 688(B11-X04): | (G/A)$_{0-20}$F(X0)TT(X)EREIVRDIKEKLCYVALDFE(X0)EMATAASSSSLEKSY(G/A)$_{0-20}$ |
| SEQ ID NO: 689(B11-X05): | (G/A)$_{0-20}$F(X0)TTA(X)REIVRDIKEKLCYVALDFE(X0)EMATAASSSSLEKSY(G/A)$_{0-20}$ |
| SEQ ID NO: 690(B11-X06): | (G/A)$_{0-20}$F(X0)TTAE(X)EIVRDIKEKLCYVALDFE(X0)EMATAASSSSLEKSY(G/A)$_{0-20}$ |
| SEQ ID NO: 691(B11-X07): | (G/A)$_{0-20}$F(X0)TTAER(X)IVRDIKEKLCYVALDFE(X0)EMATAASSSSLEKSY(G/A)$_{0-20}$ |
| SEQ ID NO: 692(B11-X08): | (G/A)$_{0-20}$F(X0)TTAERE(X)VRDIKEKLCYVALDFE(X0)EMATAASSSSLEKSY(G/A)$_{0-20}$ |
| SEQ ID NO: 693(B11-X09): | (G/A)$_{0-20}$F(X0)TTAEREI(X)RDIKEKLCYVALDFE(X0)EMATAASSSSLEKSY(G/A)$_{0-20}$ |
| SEQ ID NO: 694(B11-X10): | (G/A)$_{0-20}$F(X0)TTAEREIV(X)DIKEKLCYVALDFE(X0)EMATAASSSSLEKSY(G/A)$_{0-20}$ |
| SEQ ID NO: 695(B11-X11): | (G/A)$_{0-20}$F(X0)TTAEREIVR(X)IKEKLCYVALDFE(X0)EMATAASSSSLEKSY(G/A)$_{0-20}$ |
| SEQ ID NO: 696(B11-X12): | (G/A)$_{0-20}$F(X0)TTAEREIVRD(X)KEKLCYVALDFE(X0)EMATAASSSSLEKSY(G/A)$_{0-20}$ |
| SEQ ID NO: 697(B11-X13): | (G/A)$_{0-20}$F(X0)TTAEREIVRDI(X)EKLCYVALDFE(X0)EMATAASSSSLEKSY(G/A)$_{0-20}$ |
| SEQ ID NO: 698(B11-X14): | (G/A)$_{0-20}$F(X0)TTAEREIVRDIK(X)KLCYVALDFE(X0)EMATAASSSSLEKSY(G/A)$_{0-20}$ |
| SEQ ID NO: 699(B11-X15): | (G/A)$_{0-20}$F(X0)TTAEREIVRDIKE(X)LCYVALDFE(X0)EMATAASSSSLEKSY(G/A)$_{0-20}$ |
| SEQ ID NO: 700(B11-X16): | (G/A)$_{0-20}$F(X0)TTAEREIVRDIKEK(X)CYVALDFE(X0)EMATAASSSSLEKSY(G/A)$_{0-20}$ |
| SEQ ID NO: 701(B11-X17): | (G/A)$_{0-20}$F(X0)TTAEREIVRDIKEKL(X)YVALDFE(X0)EMATAASSSSLEKSY(G/A)$_{0-20}$ |
| SEQ ID NO: 702(B11-X18): | (G/A)$_{0-20}$F(X0)TTAEREIVRDIKEKLC(X)VALDFE(X0)EMATAASSSSLEKSY(G/A)$_{0-20}$ |
| SEQ ID NO: 703(B11-X19): | (G/A)$_{0-20}$F(X0)TTAEREIVRDIKEKLCY(X)ALDFE(X0)EMATAASSSSLEKSY(G/A)$_{0-20}$ |
| SEQ ID NO: 704(B11-X20): | (G/A)$_{0-20}$F(X0)TTAEREIVRDIKEKLCYV(X)LDFE(X0)EMATAASSSSLEKSY(G/A)$_{0-20}$ |
| SEQ ID NO: 705(B11-X21): | (G/A)$_{0-20}$F(X0)TTAEREIVRDIKEKLCYVA(X)DFE(X0)EMATAASSSSLEKSY(G/A)$_{0-20}$ |
| SEQ ID NO: 706(B11-X22): | (G/A)$_{0-20}$F(X0)TTAEREIVRDIKEKLCYVAL(X)FE(X0)EMATAASSSSLEKSY(G/A)$_{0-20}$ |
| SEQ ID NO: 707(B11-X23): | (G/A)$_{0-20}$F(X0)TTAEREIVRDIKEKLCYVALD(X)E(X0)EMATAASSSSLEKSY(G/A)$_{0-20}$ |
| SEQ ID NO: 708(B11-X24): | (G/A)$_{0-20}$F(X0)TTAEREIVRDIKEKLCYVALDF(X)(X0)EMATAASSSSLEKSY(G/A)$_{0-20}$ |
| SEQ ID NO: 709(B11-X25): | (G/A)$_{0-20}$F(X0)TTAEREIVRDIKEKLCYVALDFE(X0)(X)MATAASSSSLEKSY(G/A)$_{0-20}$ |
| SEQ ID NO: 710(B11-X26): | (G/A)$_{0-20}$F(X0)TTAEREIVRDIKEKLCYVALDFE(X0)E(X)ATAASSSSLEKSY(G/A)$_{0-20}$ |
| SEQ ID NO: 711(B11-X27): | (G/A)$_{0-20}$F(X0)TTAEREIVRDIKEKLCYVALDFE(X0)EM(X)TAASSSSLEKSY(G/A)$_{0-20}$ |
| SEQ ID NO: 712(B11-X28): | (G/A)$_{0-20}$F(X0)TTAEREIVRDIKEKLCYVALDFE(X0)EMA(X)AASSSSLEKSY(G/A)$_{0-20}$ |
| SEQ ID NO: 713(B11-X29): | (G/A)$_{0-20}$F(X0)TTAEREIVRDIKEKLCYVALDFE(X0)EMAT(X)ASSSSLEKSY(G/A)$_{0-20}$ |
| SEQ ID NO: 714(B11-X30): | (G/A)$_{0-20}$F(X0)TTAEREIVRDIKEKLCYVALDFE(X0)EMATA(X)SSSSLEKSY(G/A)$_{0-20}$ |
| SEQ ID NO: 715(B11-X31): | (G/A)$_{0-20}$F(X0)TTAEREIVRDIKEKLCYVALDFE(X0)EMATAS(X)SSSLEKSY(G/A)$_{0-20}$ |
| SEQ ID NO: 716(B11-X32): | (G/A)$_{0-20}$F(X0)TTAEREIVRDIKEKLCYVALDFE(X0)EMATASS(X)SSLEKSY(G/A)$_{0-20}$ |
| SEQ ID NO: 717(B11-X33): | (G/A)$_{0-20}$F(X0)TTAEREIVRDIKEKLCYVALDFE(X0)EMATASSS(X)SLEKSY(G/A)$_{0-20}$ |
| SEQ ID NO: 718(B11-X34): | (G/A)$_{0-20}$F(X0)TTAEREIVRDIKEKLCYVALDFE(X0)EMATASSSS(X)LEKSY(G/A)$_{0-20}$ |
| SEQ ID NO: 719(B11-X35): | (G/A)$_{0-20}$F(X0)TTAEREIVRDIKEKLCYVALDFE(X0)EMATAASSSS(X)EKSY(G/A)$_{0-20}$ |
| SEQ ID NO: 720(B11-X36): | (G/A)$_{0-20}$F(X0)TTAEREIVRDIKEKLCYVALDFE(X0)EMATAASSSSL(X)KSY(G/A)$_{0-20}$ |
| SEQ ID NO: 721(B11-X37): | (G/A)$_{0-20}$F(X0)TTAEREIVRDIKEKLCYVALDFE(X0)EMATAASSSSLE(X)SY(G/A)$_{0-20}$ |
| SEQ ID NO: 722(B11-X38): | (G/A)$_{0-20}$F(X0)TTAEREIVRDIKEKLCYVALDFE(X0)EMATAASSSSLEK(X)Y(G/A)$_{0-20}$ |
| SEQ ID NO: 723(B11-X39): | (G/A)$_{0-20}$F(X0)TTAEREIVRDIKEKLCYVALDFE(X0)EMATAASSSSLEKS(X)(G/A)$_{0-20}$ |
| SEQ ID NO: 724(B17-core): | (X)$_{0-20}$KYSVWIGGSI(X)$_{0-20}$ |

-continued

| ID (Name) | Peptide Sequence (N to C) |
|---|---|
| SEQ ID NO: 725(B17-TV01): | $(G/A)_{0-20}$(X)YSVWIGGSI$(G/A)_{0-20}$ |
| SEQ ID NO: 726(B17-TV02): | $(G/A)_{0-20}$K(X)SVWIGGSI$(G/A)_{0-20}$ |
| EQ ID NO: 727(B17-TV03): | $(G/A)_{0-20}$KY(X)VWIGGSI$(G/A)_{0-20}$ |
| SEQ ID NO: 728(B17-TV04): | $(G/A)_{0-20}$KYS(X)WIGGSI$(G/A)_{0-20}$ |
| SEQ ID NO: 729(B17-TV05): | $(G/A)_{0-20}$KYSV(X)IGGSI$(G/A)_{0-20}$ |
| SEQ ID NO: 730(B17-TV06): | $(G/A)_{0-20}$KYSVW(X)GGSI$(G/A)_{0-20}$ |
| SEQ ID NO: 731(B17-TV07): | $(G/A)_{0-20}$KYSVWI(X)GSI$(G/A)_{0-20}$ |
| SEQ ID NO: 732(B17-TV08): | $(G/A)_{0-20}$KYSVWIG(X)SI$(G/A)_{0-20}$ |
| SEQ ID NO: 733(B17-TV09): | $(G/A)_{0-20}$KYSVWIGG(X)I$(G/A)_{0-20}$ |
| SEQ ID NO: 734(B17-TV10): | $(G/A)_{0-20}$KYSVWIGGS(X)$(G/A)_{0-20}$ |
| SEQ ID NO: 735(B17-T01): | $(G/A)_{0-20}$(X0)PSTMKIKII$(G/A)_{0-20}$ |
| SEQ ID NO: 736(B17-T02): | $(G/A)_{0-20}$(X0)STMKIKIIA$(G/A)_{0-20}$ |
| SEQ ID NO: 737(B17-T03): | $(G/A)_{0-20}$(X0)TMKIKIIAP$(G/A)_{0-20}$ |
| SEQ ID NO: 738(B17-T04): | $(G/A)_{0-20}$(X0)MKIKIIAPP$(G/A)_{0-20}$ |
| SEQ ID NO: 739(B17-T05): | $(G/A)_{0-20}$(X0)KIKIIAPPE$(G/A)_{0-20}$ |
| SEQ ID NO: 740(B17-T06): | $(G/A)_{0-20}$(X0)IKIIAPPER$(G/A)_{0-20}$ |
| SEQ ID NO: 741(B17-T07): | $(G/A)_{0-20}$(X0)KIIAPPERK$(G/A)_{0-20}$ |
| SEQ ID NO: 742(B17-T08): | $(G/A)_{0-20}$(X0)IIAPPERKY$(G/A)_{0-20}$ |
| SEQ ID NO: 743(B17-T09): | $(G/A)_{0-20}$(X0)IAPPERKYS$(G/A)_{0-20}$ |
| SEQ ID NO: 744(B17-T10): | $(G/A)_{0-20}$(X0)APPERKYSV$(G/A)_{0-20}$ |
| SEQ ID NO: 745(B17-T11): | $(G/A)_{0-20}$(X0)PPERKYSVW$(G/A)_{0-20}$ |
| SEQ ID NO: 746(B17-T12): | $(G/A)_{0-20}$(X0)PERKYSVWI$(G/A)_{0-20}$ |
| SEQ ID NO: 747(B17-T13): | $(G/A)_{0-20}$(X0)ERKYSVWIG$(G/A)_{0-20}$ |
| SEQ ID NO: 748(B17-T14): | $(G/A)_{0-20}$(X0)RKYSVWIGG$(G/A)_{0-20}$ |
| SEQ ID NO: 749(B17-T15): | $(G/A)_{0-20}$(X0)KYSVWIGGS$(G/A)_{0-20}$ |
| SEQ ID NO: 750(B17-T16): | $(G/A)_{0-20}$(X0)YSVWIGGSI$(G/A)_{0-20}$ |
| SEQ ID NO: 751(B17-T17): | $(G/A)_{0-20}$(X0)SVWIGGSIL$(G/A)_{0-20}$ |
| SEQ ID NO: 752(B17-T18): | $(G/A)_{0-20}$(X0)VWIGGSILA$(G/A)_{0-20}$ |
| SEQ ID NO: 753(B17-T19): | $(G/A)_{0-20}$(X0)WIGGSILAS$(G/A)_{0-20}$ |
| SEQ ID NO: 754(B17-T20): | $(G/A)_{0-20}$(X0)IGGSILASL$(G/A)_{0-20}$ |
| SEQ ID NO: 755(B17-T21): | $(G/A)_{0-20}$(X0)GGSILASLS$(G/A)_{0-20}$ |
| SEQ ID NO: 756(B17-T22): | $(G/A)_{0-20}$(X0)GSILASLST$(G/A)_{0-20}$ |
| SEQ ID NO: 757(B17-T23): | $(G/A)_{0-20}$(X0)SILASLSTF$(G/A)_{0-20}$ |
| SEQ ID NO: 758(B17-T24): | $(G/A)_{0-20}$(X0)ILASLSTFQ$(G/A)_{0-20}$ |
| SEQ ID NO: 759(B17-T25): | $(G/A)_{0-20}$(X0)LASLSTFQQ$(G/A)_{0-20}$ |
| SEQ ID NO: 760(B17-T26): | $(G/A)_{0-20}$(X0)ASLSTFQQM$(G/A)_{0-20}$ |
| SEQ ID NO: 761(B17-T27): | $(G/A)_{0-20}$(X0)SLSTFQQMW$(G/A)_{0-20}$ |
| SEQ ID NO: 762(B17-T28): | $(G/A)_{0-20}$(X0)LSTFQQMWI$(G/A)_{0-20}$ |
| SEQ ID NO: 763(B17-T29): | $(G/A)_{0-20}$LSTFQQMWI(X0)$(G/A)_{0-20}$ |

-continued

| ID (Name) | Peptide Sequence (N to C) |
|---|---|
| SEQ ID NO: 764(B17-T30): | (G/A)$_{0-20}$STFQQMWI(X0)K(G/A)$_{0-20}$ |
| SEQ ID NO: 765(B17-T31): | (G/A)$_{0-20}$TFQQMWI(X0)KQ(G/A)$_{0-20}$ |
| SEQ ID NO: 766(B17-M01): | (G/A)$_{0-20}$APSTMKIKIIAPPERKYSVW(G/A)$_{0-20}$ |
| SEQ ID NO: 767(B17-M02): | (G/A)$_{0-20}$PSTMKIKIIAPPERKYSVWI(G/A)$_{0-20}$ |
| SEQ ID NO: 768(B17-M03): | (G/A)$_{0-20}$STMKIKIIAPPERKYSVWIG(G/A)$_{0-20}$ |
| SEQ ID NO: 769(B17-M04): | (G/A)$_{0-20}$TMKIKIIAPPERKYSVWIGG(G/A)$_{0-20}$ |
| SEQ ID NO: 770(B17-M05): | (G/A)$_{0-20}$MKIKIIAPPERKYSVWIGGS(G/A)$_{0-20}$ |
| SEQ ID NO: 771(B17-M06): | (G/A)$_{0-20}$KIKIIAPPERKYSVWIGGSI(G/A)$_{0-20}$ |
| SEQ ID NO: 772(B17-M07): | (G/A)$_{0-20}$IKIIAPPERKYSVWIGGSIL(G/A)$_{0-20}$ |
| SEQ ID NO: 773(B17-M08): | (G/A)$_{0-20}$KIIAPPERKYSVWIGGSILA(G/A)$_{0-20}$ |
| SEQ ID NO: 774(B17-M09): | (G/A)$_{0-20}$IIAPPERKYSVWIGGSILAS(G/A)$_{0-20}$ |
| SEQ ID NO: 775(B17-M10): | (G/A)$_{0-20}$IAPPERKYSVWIGGSILASL(G/A)$_{0-20}$ |
| SEQ ID NO: 776(B17 ): | (G/A)$_{0-20}$APPERKYSVWIGGSILASLS(G/A)$_{0-20}$ |
| SEQ ID NO: 777(B17-P01): | (G/A)$_{0-20}$PPERKYSVWIGGSILASLST(G/A)$_{0-20}$ |
| SEQ ID NO: 778(B17-P02): | (G/A)$_{0-20}$PERKYSVWIGGSILASLSTF(G/A)$_{0-20}$ |
| SEQ ID NO: 779(B17-P03): | (G/A)$_{0-20}$ERKYSVWIGGSILASLSTFQ(G/A)$_{0-20}$ |
| SEQ ID NO: 780(B17-P04): | (G/A)$_{0-20}$RKYSVWIGGSILASLSTFQQ(G/A)$_{0-20}$ |
| SEQ ID NO: 781(B17-P05): | (G/A)$_{0-20}$KYSVWIGGSILASLSTFQQM(G/A)$_{0-20}$ |
| SEQ ID NO: 782(B17-P06): | (G/A)$_{0-20}$YSVWIGGSILASLSTFQQMW(G/A)$_{0-20}$ |
| SEQ ID NO: 783(B17-P07): | (G/A)$_{0-20}$SVWIGGSILASLSTFQQMWI(G/A)$_{0-20}$ |
| SEQ ID NO: 784(B17-P08): | (G/A)$_{0-20}$VWIGGSILASLSTFQQMWI(X0)(G/A)$_{0-20}$ |
| SEQ ID NO: 785(B17-P09): | (G/A)$_{0-20}$WIGGSILASLSTFQQMWI(X0)K(G/A)$_{0-20}$ |
| SEQ ID NO: 786(B17-P10): | (G/A)$_{0-20}$IGGSILASLSTFQQMWI(X0)KQ(G/A)$_{0-20}$ |
| SEQ ID NO: 787(B17-V01): | (G/A)$_{0-20}$(X)PPERKYSVWIGGSILASLS(G/A)$_{0-20}$ |
| SEQ ID NO: 788(B17-V02): | (G/A)$_{0-20}$A(X)PERKYSVWIGGSILASLS(G/A)$_{0-20}$ |
| SEQ ID NO: 789(B17-V03): | (G/A)$_{0-20}$AP(X)ERKYSVWIGGSILASLS(G/A)$_{0-20}$ |
| SEQ ID NO: 790(B17-V04): | (G/A)$_{0-20}$APP(X)RKYSVWIGGSILASLS(G/A)$_{0-20}$ |
| SEQ ID NO: 791(B17-V05): | (G/A)$_{0-20}$APPE(X)KYSVWIGGSILASLS(G/A)$_{0-20}$ |
| SEQ ID NO: 792(B17-V06): | (G/A)$_{0-20}$APPER(X)YSVWIGGSILASLS(G/A)$_{0-20}$ |
| SEQ ID NO: 793(B17-V07): | (G/A)$_{0-20}$APPERK(X)SVWIGGSILASLS(G/A)$_{0-20}$ |
| SEQ ID NO: 794(B17-V08): | (G/A)$_{0-20}$APPERKY(X)VWIGGSILASLS(G/A)$_{0-20}$ |
| SEQ ID NO: 795(B17-V09): | (G/A)$_{0-20}$APPERKYS(X)WIGGSILASLS(G/A)$_{0-20}$ |
| SEQ ID NO: 796(B17-V10): | (G/A)$_{0-20}$APPERKYSV(X)IGGSILASLS(G/A)$_{0-20}$ |
| SEQ ID NO: 797(B17-V11): | (G/A)$_{0-20}$APPERKYSVW(X)GGSILASLS(G/A)$_{0-20}$ |
| SEQ ID NO: 798(B17-V12): | (G/A)$_{0-20}$APPERKYSVWI(X)GSILASLS(G/A)$_{0-20}$ |
| SEQ ID NO: 799(B17-V13): | (G/A)$_{0-20}$APPERKYSVWIG(X)SILASLS(G/A)$_{0-20}$ |
| SEQ ID NO: 800(B17-V14): | (G/A)$_{0-20}$APPERKYSVWIGG(X)ILASLS(G/A)$_{0-20}$ |
| SEQ ID NO: 801(B17-V15): | (G/A)$_{0-20}$APPERKYSVWIGGS(X)LASLS(G/A)$_{0-20}$ |
| SEQ ID NO: 802(B17-V16): | (G/A)$_{0-20}$APPERKYSVWIGGSI(X)ASLS(G/A)$_{0-20}$ |

-continued

| ID (Name) | Peptide Sequence (N to C) |
|---|---|
| SEQ ID NO: 803(B17-V17): | $(G/A)_{0-20}$APPERKYSVWIGGSIL(X)SLS$(G/A)_{0-20}$ |
| SEQ ID NO: 804(B17-V18): | $(G/A)_{0-20}$APPERKYSVWIGGSILA(X)LS$(G/A)_{0-20}$ |
| SEQ ID NO: 805(B17-V19): | $(G/A)_{0-20}$APPERKYSVWIGGSILAS(X)S$(G/A)_{0-20}$ |
| SEQ ID NO: 806(B17-V20): | $(G/A)_{0-20}$APPERKYSVWIGGSILASL(X)$(G/A)_{0-20}$ |
| SEQ ID NO: 807(B17-X01): | $(G/A)_{0-20}$(X)PSTMKIKIIAPPERKYSVWIGGSILASLSTFQQMWI(X0)KQ$(G/A)_{0-20}$ |
| SEQ ID NO: 808(B17-X02): | $(G/A)_{0-20}$A(X)STMKIKIIAPPERKYSVWIGGSILASLSTFQQMWI(X0)KQ$(G/A)_{0-20}$ |
| SEQ ID NO: 809(B17-X03): | $(G/A)_{0-20}$AP(X)TMKIKIIAPPERKYSVWIGGSILASLSTFQQMWI(X0)KQ$(G/A)_{0-20}$ |
| SEQ ID NO: 810(B17-X04): | $(G/A)_{0-20}$APS(X)MKIKIIAPPERKYSVWIGGSILASLSTFQQMWI(X0)KQ$(G/A)_{0-20}$ |
| SEQ ID NO: 811(B17-X05): | $(G/A)_{0-20}$APST(X)KIKIIAPPERKYSVWIGGSILASLSTFQQMWI(X0)KQ$(G/A)_{0-20}$ |
| SEQ ID NO: 812(B17-X06): | $(G/A)_{0-20}$APSTM(X)IKIIAPPERKYSVWIGGSILASLSTFQQMWI(X0)KQ$(G/A)_{0-20}$ |
| SEQ ID NO: 813(B17-X07): | $(G/A)_{0-20}$APSTMK(X)KIIAPPERKYSVWIGGSILASLSTFQQMWI(X0)KQ$(G/A)_{0-20}$ |
| SEQ ID NO: 814(B17-X08): | $(G/A)_{0-20}$APSTMKI(X)IIAPPERKYSVWIGGSILASLSTFQQMWI(X0)KQ$(G/A)_{0-20}$ |
| SEQ ID NO: 815(B17-X09): | $(G/A)_{0-20}$APSTMKIK(X)IAPPERKYSVWIGGSILASLSTFQQMWI(X0)KQ$(G/A)_{0-20}$ |
| SEQ ID NO: 816(B17-X10): | $(G/A)_{0-20}$APSTMKIKI(X)APPERKYSVWIGGSILASLSTFQQMWI(X0)KQ$(G/A)_{0-20}$ |
| SEQ ID NO: 817(B17-X11): | $(G/A)_{0-20}$APSTMKIKII(X)PPERKYSVWIGGSILASLSTFQQMWI(X0)KQ$(G/A)_{0-20}$ |
| SEQ ID NO: 818(B17-X12): | $(G/A)_{0-20}$APSTMKIKIIA(X)PERKYSVWIGGSILASLSTFQQMWI(X0)KQ$(G/A)_{0-20}$ |
| SEQ ID NO: 819(B17-X13): | $(G/A)_{0-20}$APSTMKIKIIAP(X)ERKYSVWIGGSILASLSTFQQMWI(X0)KQ$(G/A)_{0-20}$ |
| SEQ ID NO: 820(B17-X15): | $(G/A)_{0-20}$APSTMKIKIIAPP(X)RKYSVWIGGSILASLSTFQQMWI(X0)KQ$(G/A)_{0-20}$ |
| SEQ ID NO: 821(B17-X16): | $(G/A)_{0-20}$APSTMKIKIIAPPE(X)KYSVWIGGSILASLSTFQQMWI(X0)KQ$(G/A)_{0-20}$ |
| SEQ ID NO: 822(B17-X17): | $(G/A)_{0-20}$APSTMKIKIIAPPER(X)YSVWIGGSILASLSTFQQMWI(X0)KQ$(G/A)_{0-20}$ |
| SEQ ID NO: 823(B17-X18): | $(G/A)_{0-20}$APSTMKIKIIAPPERK(X)SVWIGGSILASLSTFQQMWI(X0)KQ$(G/A)_{0-20}$ |
| SEQ ID NO: 824(B17-X19): | $(G/A)_{0-20}$APSTMKIKIIAPPERKY(X)VWIGGSILASLSTFQQMWI(X0)KQ$(G/A)_{0-20}$ |
| SEQ ID NO: 825(B17-X20): | $(G/A)_{0-20}$APSTMKIKIIAPPERKYS(X)WIGGSILASLSTFQQMWI(X0)KQ$(G/A)_{0-20}$ |
| SEQ ID NO: 826(B17-X21): | $(G/A)_{0-20}$APSTMKIKIIAPPERKYSV(X)IGGSILASLSTFQQMWI(X0)KQ$(G/A)_{0-20}$ |
| SEQ ID NO: 827(B17-X22): | $(G/A)_{0-20}$APSTMKIKIIAPPERKYSVW(X)GGSILASLSTFQQMWI(X0)KQ$(G/A)_{0-20}$ |
| SEQ ID NO: 828(B17-X23): | $(G/A)_{0-20}$APSTMKIKIIAPPERKYSVWI(X)GSILASLSTFQQMWI(X0)KQ$(G/A)_{0-20}$ |
| SEQ ID NO: 829(B17-X24): | $(G/A)_{0-20}$APSTMKIKIIAPPERKYSVWIG(X)SILASLSTFQQMWI(X0)KQ$(G/A)_{0-20}$ |
| SEQ ID NO: 830(B17-X25): | $(G/A)_{0-20}$APSTMKIKIIAPPERKYSVWIGG(X)ILASLSTFQQMWI(X0)KQ$(G/A)_{0-20}$ |
| SEQ ID NO: 831(B17-X26): | $(G/A)_{0-20}$APSTMKIKIIAPPERKYSVWIGGS(X)LASLSTFQQMWI(X0)KQ$(G/A)_{0-20}$ |
| SEQ ID NO: 832(B17-X27): | $(G/A)_{0-20}$APSTMKIKIIAPPERKYSVWIGGSI(X)ASLSTFQQMWI(X0)KQ$(G/A)_{0-20}$ |
| SEQ ID NO: 833(B17-X28): | $(G/A)_{0-20}$APSTMKIKIIAPPERKYSVWIGGSIL(X)SLSTFQQMWI(X0)KQ$(G/A)_{0-20}$ |
| SEQ ID NO: 834(B17-X29): | $(G/A)_{0-20}$APSTMKIKIIAPPERKYSVWIGGSILA(X)LSTFQQMWI(X0)KQ$(G/A)_{0-20}$ |
| SEQ ID NO: 835(B17-X30): | $(G/A)_{0-20}$APSTMKIKIIAPPERKYSVWIGGSILAS(X)STFQQMWI(X0)KQ$(G/A)_{0-20}$ |
| SEQ ID NO: 836(B17-X31): | $(G/A)_{0-20}$APSTMKIKIIAPPERKYSVWIGGSILASL(X)TFQQMWI(X0)KQ$(G/A)_{0-20}$ |
| SEQ ID NO: 837(B17-X32): | $(G/A)_{0-20}$APSTMKIKIIAPPERKYSVWIGGSILASLS(X)FQQMWI(X0)KQ$(G/A)_{0-20}$ |
| SEQ ID NO: 838(B17-X33): | $(G/A)_{0-20}$APSTMKIKIIAPPERKYSVWIGGSILASLST(X)QQMWI(X0)KQ$(G/A)_{0-20}$ |
| SEQ ID NO: 839(B17-X34): | $(G/A)_{0-20}$APSTMKIKIIAPPERKYSVWIGGSILASLSTF(X)QMWI(X0)KQ$(G/A)_{0-20}$ |
| SEQ ID NO: 840(B17-X35): | $(G/A)_{0-20}$APSTMKIKIIAPPERKYSVWIGGSILASLSTFQ(X)MWI(X0)KQ$(G/A)_{0-20}$ |
| SEQ ID NO: 841(B17-X36): | $(G/A)_{0-20}$APSTMKIKIIAPPERKYSVWIGGSILASLSTFQQ(X)WI(X0)KQ$(G/A)_{0-20}$ |

| ID (Name) | Peptide Sequence (N to C) |
|---|---|
| SEQ ID NO: 842 (B17-X37): | (G/A)$_{0-20}$APSTMKIKIIAPPERKYSVWIGGSILASLSTFQQM(X)I(X0)KQ(G/A)$_{0-20}$ |
| SEQ ID NO: 843 (B17-X38): | (G/A)$_{0-20}$APSTMKIKIIAPPERKYSVWIGGSILASLSTFQQMW(X)(X0)KQ(G/A)$_{0-20}$ |
| SEQ ID NO: 844 (B17-X39): | (G/A)$_{0-20}$APSTMKIKIIAPPERKYSVWIGGSILASLSTFQQMWI(X0)(X)Q(G/A)$_{0-20}$ |
| SEQ ID NO: 845 (B17-X40): | (G/A)$_{0-20}$APSTMKIKIIAPPERKYSVWIGGSILASLSTFQQMWI(X0)K(X)(G/A)$_{0-20}$ |

In another embodiment, a peptide according to formula SEQ ID No:1 to SEQ ID No:845 is a cyclic peptide. A cyclic peptide can be made by covalently crosslinking amino acid residues together via a disulfide bond (e.g., thiol group of cysteine) or a side chain of amino acid residues (e.g., Lye, Arg, Ser, Tyr). Furthermore, a functionalized linker (e.g., polyethylene glycol or PEG) can be introduced to generate a cyclic peptide.

Although the sequences enumerated here comprise 40 AA, 20 AA, and 10 AA, it is to be understood that peptides of the invention may include any length from 5 to 40 AA.

Numerous permutations and variations of the present invention are readily apparent to a person of ordinary skill in the art in view of this disclosure. Therefore it is to be understood that the invention may be practiced otherwise than as specifically described herein.

TABLE 1

Actin alignment
As one can see below from the actin protein sequences of human, mouse, rabbit, and fly, the actin sequence is highly conserved.

| | |
|---|---|
| SEQ ID NO: 846: | Human ACTA1: Human ACTA1 (alpha skeletal muscle actin) |
| SEQ ID NO: 847: | Human ACTAC1: Human ACTC1 (alpha cardiac muscle actin) |
| SEQ ID NO: 848: | Human ACTAB: Human ACTB (cytoplasmic 1 actin) |
| SEQ ID NO: 849: | Human ACTABG1: Human ACTG1 (cytoplasmic 2 actin) |
| SEQ ID NO: 850: | Mouse ACTB: *Mus musculus* Actin, beta |
| SEQ ID NO: 851: | Rabbit ACTB: *Orycytolagus cuniculus* ACTB (cytoplasmic 1 actin |
| SEQ ID NO: 852: | Fly ACTB: *Drosophila* actin Actin5C, (Isoform B) |

```
                      10         20         30         40         50
SEQ ID NO: 846:    MCDEDETTALVC DNGSGLVKAG FAGDDAPRAV FPSIVGRPRH QGVMVGMGQK
SEQ ID NO: 847:    MCDDEETTALVC DNGSGLVKAG FAGDDAPRAV FPSIVGRPRH QGVMVGMGQK
SEQ ID NO: 848:    MDDDIAALVV  DNGSGMCKAG FAGDDAPRAV FPSIVGRPRH QGVMVGMGQK
SEQ ID NO: 849:    MEEEIAALVI  DNGSGMCKAG FAGDDAPRAV FPSIVGRPRH QGVMVGMGQK
SEQ ID NO: 850:    MDDDIAALVV  DNGSGMCKAG FAGDDAPRAV FPSIVGRPRH QGVMVGMGQK
SEQ ID NO: 851:    MDDDIAALVV  DNGSGMCKAG FAGDDAPRAV FPSIVGRPRH QGVMVGMGQK
SEQ ID NO: 852:    MCDEEVAALVV DNGSGMCKAG FAGDDAPRAV FPSIVGRPRH QGVMVGMGQK 60         70         80         90        100
SEQ ID NO: 846:    DSYVGDEAQS KRGILTLKYP IEHGIITNWD DMEKIWHHTF YNELRVAPEE
SEQ ID NO: 847:    DSYVGDEAQS KRGILTLKYP IEHGIITNWD DMEKIWHHTF YNELRVAPEE
SEQ ID NO: 848:    DSYVGDEAQS KRGILTLKYP IEHGIVTNWD DMEKIWHHTF YNELRVAPEE
SEQ ID NO: 849:    DSYVGDEAQS KRGILTLKYP IEHGIVTNWD DMEKIWHHTF YNELRVAPEE
SEQ ID NO: 850:    DSYVGDEAQS KRGILTLKYP IEHGIVTNWD DMEKIWHHTF YNELRVAPEE
SEQ ID NO: 851:    DSYVGDEAQS KRGILTLKYP IEHGIVTNWD DMEKIWHHTF YNELRVAPEE
SEQ IE NO: 852:    DSYVGDEAQS KRGILTLKYP IEHGIVTNWD DMEKIWHHTF YNELRVAPEE 110        120        130        140        150
SEQ ID NO: 846:    HPTLLTEAPL NPKANREKMT QIMFETFNVP AMYVAIQAVL SLYASGRTTG
SEQ ID NO: 847:    HPTLLTEAPL NPKANREKMT QIMFETFNVP AMYVAIQAVL SLYASGRTTG
SEQ ID NO: 848:    HPVLLTEAPL NPKANREKMT QIMFETFNIP AMYVAIQAVL SLYASGRTTG
```

TABLE 1-continued

Actin alignment
As one can see below from the actin protein sequences of human,
mouse, rabbit, and fly, the actin sequence is highly conserved.

```
SEQ ID NO: 849:    HPVLLTEAPL NPKANREKMT QIMFETFNIP AMYVAIQAVL SLYASGRTTG

SEQ ID NO: 850:    HPVLLTEAPL NPKANREKMT QIMFETFNIP AMYVAIQAVL SLYASGRTTG

SEQ ID NO: 851:    RPVLLTEAPL NPKANREKMT QIMFETFNIP AMYVAIQAVL SLYASGRTTG

SEQ ID NO: 852:    HPVLLTEAPL NPKANREKMT QIMFETFNIP AMYVAIQAVL SLYASGRTTG 160        170        180        190        200
SEQ ID NO: 846:    IVLDSGDGVT HNVPIYEGYA LPHAIMRLDL AGRDLTDYLM KILTERGYSF

SEQ ID NO: 847:    IVLDSGDGVT HNVPIYEGYA LPHAIMRLDL AGRDLTDYLM KILTERGYSF

SEQ ID NO: 848:    IVMDSGDGVT HTVPIYEGYA LPHAILRLDL AGRDLTDYLM KILTERGYSF

SEQ ID NO: 849:    IVMDSGDGVT HTVPIYEGYA LPHAILRLDL AGRDLTDYLM KILTERGYSF

SEQ ID NO: 850:    IVMDSGDGVT HTVPIYEGYA LPHAILRLDL AGRDLTDYLM KILTERGYSF

SEQ ID NO: 851:    IVMDSGDGVT HTVPIYEGYA LPHAILRLDL AGRDLTDYLM KILTERGYSF

SEQ ID NO: 852:    IVLDSGDGVS HTVPIYEGYA LPHAILRLDL AGRDLTDYLM KILTERGYSF 210        220        230        240        250
SEQ ID NO: 846:    VTTAEREIVR DIKEKLCYVA LDFENEMATA ASSSSLEKSY ELPDGQVITI

SEQ ID NO: 847:    VTTAEREIVR DIKEKLCYVA LDFENEMATA ASSSSLEKSY ELPDGQVITI

SEQ ID NO: 848:    ITTAEREIVR DIKEKLCYVA LDFEQEMATA ASSSSLEKSY ELPDGQVITI

SEQ ID NO: 849:    ITTAEREIVR DIKEKLCYVA LDFEQEMATA ASSSSLEKSY ELPDGQVITI

SEQ ID NO: 850:    ITTAEREIVR DIKEKLCYVA LDFEQEMATA ASSSSLEKSY ELPDGQVITI

SEQ ID NO: 851:    ITTAEREIVR DIKEKLCYVA LDFEQEMATA ASSSSLEKSY ELPDGQVITI

SEQ ID NO: 852:    ITTAEREIVR DIKEKLCYVA LDFEQEMATA ASSSSLEKSY ELPDGQVITI 260        270        280        290        300
SEQ ID NO: 846:    GNERFRCPET LFQPSFIGME SAGIHETTYN SIMKCDIDIR KDLYANNVMS

SEQ ID NO: 847:    GNERFRCPET LFQPSFIGME SAGIHETTYN SIMKCDIDIR KDLYANNVLS

SEQ ID NO: 848:    GNERFRCPEA LFQPSFLGME SCGIHETTFN SIMKCDVDIR KDLYANTVLS

SEQ ID NO: 849:    GNERFRCPEA LFQPSFLGME SCGIHETTFN SIMKCDVDIR KDLYANTVLS

SEQ ID NO: 850:    GNERFRCPEA LFQPSFLGME SCGIHETTFN SIMKCDVDIR KDLYANTVLS

SEQ ID NO: 851:    GNERFRCPEA LFQPSFLGME SCGIHETTFN SIMKCDVDIR KDLYANTVLS

SEQ ID NO: 852:    GNERFRCPEA LFQPSFLGME ACGIHETTYN SIMKCDVDIR KDLYANTVLS 310        320        330        340        350
SEQ ID NO: 846:    GGITMYPGIA DRMQKEITAL APSTMKIKII APPERKYSVW IGGSILASLS

SEQ ID NO: 847:    GGITMYPGIA DRMQKEITAL APSTMKIKII APPERKYSVW IGGSILASLS

SEQ ID NO: 848:    GGITMYPGIA DRMQKEITAL APSTMKIKII APPERKYSVW IGGSILASLS

SEQ ID NO: 849:    GGITMYPGIA DRMQKEITAL APSTMKIKII APPERKYSVW IGGSILASLS

SEQ ID NO: 850:    GGITMYPGIA DRMQKEITAL APSTMKIKII APPERKYSVW IGGSILASLS

SEQ ID NO: 851:    GGITMYPGIA DRMQKEITAL APSTMKIKII APPERKYSVW IGGSILASLS

SEQ ID NO: 852:    GGITMYPGIA DRMQKEITAL APSTMKIKII APPERKYSVW IGGSILASLS 360        370
SEQ ID NO: 846:    TFQQMWITKQ EYDEAGPSIV HRKCF

SEQ ID NO: 847:    TFQQMWISKQ EYDEAGPSIV HRKCF

SEQ ID NO: 848:    TFQQMWISKQ EYDESGPSIV HRKCF
```

SEQUENCE LISTING (858 sequences)

SEQ ID NO: 1 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXYNELRVAPEE

SEQ ID NO: 2 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXQIMFETFNTP

SEQ ID NO: 3 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXLPHAILRLDL

SEQ ID NO: 4 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXAGRDLTDYLM

SEQ ID NO: 5 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXLCYVALDFEQ

SEQ ID NO: 6 - protein, 38 aa, Artificial Sequence
  synthetic peptide
  MISC_FEATURE (9)..(28): Xaa may be Gly, Ala, or absent.
RRRRRRRRXXXXXXXXXXXXXXXXXXXXKYSVWIGGSI

SEQ ID NO: 7 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXYNELRVAPEEHPVLLTEAPL

SEQ ID NO: 8 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXNPKANREKMTQIMFETFNTP

SEQ ID NO: 9 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXQIMFETFNTPAMYVAIQAVL

SEQ ID NO: 10 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXHTVPIYEGYALPHAILRLDL

SEQ ID NO: 11 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXLPHAILRLDLAGRDLTDYLM

SEQ ID NO: 12 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXAGRDLTDYLMKILTERGYSF

SEQ ID NO: 13 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXDIKEKLCYVALDFEQEMATA

SEQ ID NO: 14 - protein, 48 aa, Artificial Sequence
  synthetic peptide
  MISC_FEATURE (9)..(28): Xaa may be Gly, Ala, or absent.
RRRRRRRRXXXXXXXXXXXXXXXXXXXXAPPERKYSVWIGGSILASLS

SEQ ID NO: 15 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (21)..(21): Xaa may be any naturally-occurring amino acid or any unnatural amino acid.
  MISC_FEATURE (31)..(50): Xaa may be any naturally-occurring amino acid or any unnatural amino acid or absent.
XXXXXXXXXXXXXXXXXXXXXNELRVAPEEXXXXXXXXXXXXXXXXXXXX

SEQ ID NO: 16 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXYXELRVAPEEXXXXXXXXXXXXXXXXXXXX

SEQ ID NO: 17 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXYNXLRVAPEEXXXXXXXXXXXXXXXXXXXX

SEQ ID NO: 18 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXYNEXRVAPEEXXXXXXXXXXXXXXXXXXXX

SEQ ID NO: 19 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELXVAPEEXXXXXXXXXXXXXXXXXXXX

SEQ ID NO: 20 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELRXAPEEXXXXXXXXXXXXXXXXXXXX

SEQ ID NO: 21 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELRVXPEEXXXXXXXXXXXXXXXXXXXX

SEQ ID NO: 22 - protein, 50 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELRVAXEEXXXXXXXXXXXXXXXXXXXX

SEQ ID NO: 23 - protein, 50 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELRVAPXEXXXXXXXXXXXXXXXXXXXX

SEQ ID NO: 24 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXYNELRVAPEXXXXXXXXXXXXXXXXXXXXX

SEQ ID NO: 25 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (31)..(50): Xaa may be any naturally-occurring amino acid or any unnatural amino acid or absent.
XXXXXXXXXXXXXXXXXXXXWHHTFYNELRXXXXXXXXXXXXXXXXXXXX

SEQ ID NO: 26 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXWXHTFYNELRXXXXXXXXXXXXXXXXXXXX

SEQ ID NO: 27 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXWHXTFYNELRXXXXXXXXXXXXXXXXXXXX

SEQ ID NO: 28 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHXFYNELRXXXXXXXXXXXXXXXXXXXX

SEQ ID NO: 29 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTXYNELRXXXXXXXXXXXXXXXXXXXX

SEQ ID NO: 30 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTFXNELRXXXXXXXXXXXXXXXXXXXX

SEQ ID NO: 31 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTFYXELRXXXXXXXXXXXXXXXXXXXX

SEQ ID NO: 32 - protein, 50 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTFYNXLRXXXXXXXXXXXXXXXXXXXX

SEQ ID NO: 33 - protein, 50 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTFYNEXRXXXXXXXXXXXXXXXXXXXX

SEQ ID NO: 34 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXWHHTFYNELXXXXXXXXXXXXXXXXXXXXX

SEQ ID NO: 35 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXVTNWDDMEKIXXXXXXXXXXXXXXXXXXXX

SEQ ID NO: 36 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXTNWDDMEKIWXXXXXXXXXXXXXXXXXXXX

SEQ ID NO: 37 - protein, 50 aa, Artificial Sequence
  synthetic protein
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXNWDDMEKIWHXXXXXXXXXXXXXXXXXXXX

SEQ ID NO: 38 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXWDDMEKIWHHXXXXXXXXXXXXXXXXXXXX

SEQ ID NO: 39 - protein, 50 aa, Artificial Sequence
  synthetic protein
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXDDMEKIWHHTXXXXXXXXXXXXXXXXXXXX

SEQ ID NO: 40 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXDMEKIWHHTFXXXXXXXXXXXXXXXXXXXX

SEQ ID NO: 41 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXMEKIWHHTFYXXXXXXXXXXXXXXXXXXXX

SEQ ID NO: 42 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXEKIWHHTFYNXXXXXXXXXXXXXXXXXXXX

SEQ ID NO: 43 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXKIWHHTFYNEXXXXXXXXXXXXXXXXXXXX

SEQ ID NO: 44 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXIWHHTFYNELXXXXXXXXXXXXXXXXXXXX

SEQ ID NO: 45 - protein, 50 aa, Artificial Sequence; identical to SEQ ID NO: 25
  synthetic peptide
  MISC_FEATURE (1)..(20): Xaa may be Gly, Ala, or absent.
  MISC_FEATURE (31)..(50): Xaa may be Gly, Ala, or absent.

SEQ ID NO: 46 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXHHTFYNELRVXXXXXXXXXXXXXXXXXXXX

SEQ ID NO: 47 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXHTFYNELRVAXXXXXXXXXXXXXXXXXXXX

SEQ ID NO: 48 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXTFYNELRVAPXXXXXXXXXXXXXXXXXXXX

SEQ ID NO: 49 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXFYNELRVAPEXXXXXXXXXXXXXXXXXXXX

SEQ ID NO: 50 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXYNELRVAPEEXXXXXXXXXXXXXXXXXXXX

SEQ ID NO: 51 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXNELRVAPEEHXXXXXXXXXXXXXXXXXXXX

SEQ ID NO: 52 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXELRVAPEEHPXXXXXXXXXXXXXXXXXXXX

SEQ ID NO: 53 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLRVAPEEHPVXXXXXXXXXXXXXXXXXXXX

SEQ ID NO: 54 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXRVAPEEHPVLXXXXXXXXXXXXXXXXXXXX

SEQ ID NO: 55 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXVAPEEHPVLLXXXXXXXXXXXXXXXXXXXX

SEQ ID NO: 56 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXAPEEHPVLLTXXXXXXXXXXXXXXXXXXXX

SEQ ID NO: 57 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXPEEHPVLLTEXXXXXXXXXXXXXXXXXXXX

SEQ ID NO: 58 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXEEHPVLLTEAXXXXXXXXXXXXXXXXXXXX

SEQ ID NO: 59 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXEHPVLLTEAPXXXXXXXXXXXXXXXXXXXX

SEQ ID NO: 60 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXHPVLLTEAPLXXXXXXXXXXXXXXXXXXXX

SEQ ID NO: 61 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXPVLLTEAPLNXXXXXXXXXXXXXXXXXXXX

SEQ ID NO: 62 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXVLLTEAPLNPXXXXXXXXXXXXXXXXXXXX

SEQ ID NO: 63 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLLTEAPLNPKXXXXXXXXXXXXXXXXXXXX

SEQ ID NO: 64 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLTEAPLNPKAXXXXXXXXXXXXXXXXXXXX

SEQ ID NO: 65 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXTEAPLNPKANXXXXXXXXXXXXXXXXXXXX

SEQ ID NO: 66 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXEHGIVTNWDDMEKIWHHTFYXXXXXXXXXXXXXXXXXXXX

SEQ ID NO: 67 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXHGIVTNWDDMEKIWHHTFYNXXXXXXXXXXXXXXXXXXXX

SEQ ID NO: 68 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXGIVTNWDDMEKIWHHTFYNEXXXXXXXXXXXXXXXXXXXX

SEQ ID NO: 69 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXIVTNWDDMEKIWHHTFYNELXXXXXXXXXXXXXXXXXXXX

SEQ ID NO: 70 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXVTNWDDMEKIWHHTFYNELRXXXXXXXXXXXXXXXXXXXX

SEQ ID NO: 71 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXTNWDDMEKIWHHTFYNELRVXXXXXXXXXXXXXXXXXXXX

SEQ ID NO: 72 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXNWDDMEKIWHHTFYNELRVAXXXXXXXXXXXXXXXXXXXX

SEQ ID NO: 73 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXWDDMEKIWHHTFYNELRVAPXXXXXXXXXXXXXXXXXXXX

SEQ ID NO: 74 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXDDMEKIWHHTFYNELRVAPEXXXXXXXXXXXXXXXXXXXX

SEQ ID NO: 75 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXDMEKIWHHTFYNELRVAPEEXXXXXXXXXXXXXXXXXXXX

SEQ ID NO: 76 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXMEKIWHHTFYNELRVAPEEHXXXXXXXXXXXXXXXXXXXX

SEQ ID NO: 77 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXEKIWHHTFYNELRVAPEEHPXXXXXXXXXXXXXXXXXXXX

SEQ ID NO: 78 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXKIWHHTFYNELRVAPEEHPVXXXXXXXXXXXXXXXXXXXX

SEQ ID NO: 79 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXIWHHTFYNELRVAPEEHPVLXXXXXXXXXXXXXXXXXXXX

SEQ ID NO: 80 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXWHHTFYNELRVAPEEHPVLLXXXXXXXXXXXXXXXXXXXX

SEQ ID NO: 81 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXHHTFYNELRVAPEEHPVLLTXXXXXXXXXXXXXXXXXXXX

SEQ ID NO: 82 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXHTFYNELRVAPEEHPVLLTEXXXXXXXXXXXXXXXXXXXX

SEQ ID NO: 83 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXTFYNELRVAPEEHPVLLTEAXXXXXXXXXXXXXXXXXXXX

SEQ ID NO: 84 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXFYNELRVAPEEHPVLLTEAPXXXXXXXXXXXXXXXXXXXX

SEQ ID NO: 85 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXYNELRVAPEEHPVLLTEAPLXXXXXXXXXXXXXXXXXXXX

SEQ ID NO: 86 - protein, 60 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid
  MISC_FEATURE (41)..(60): Xaa may be Gly, Ala, or absent.
XXXXXXXXXXXXXXXXXXXXXMEKIWHHTFYNELRVAPEEXXXXXXXXXXXXXXXXXXXX

SEQ ID NO: 87 - protein, 60 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (41)..(60): Xaa may be Gly, Ala, or absent.
XXXXXXXXXXXXXXXXXXXXDXEKIWHHTFYNELRVAPEEXXXXXXXXXXXXXXXXXXXX

SEQ ID NO: 88 - protein, 60 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (41)..(60): Xaa may be Gly, Ala, or absent.
XXXXXXXXXXXXXXXXXXXXDMXKIWHHTFYNELRVAPEEXXXXXXXXXXXXXXXXXXXX

SEQ ID NO: 89 - protein, 60 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEXIWHHTFYNELRVAPEEXXXXXXXXXXXXXXXXXXXX

SEQ ID NO: 90 - protein, 60 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKXWHHTFYNELRVAPEEXXXXXXXXXXXXXXXXXXXX

SEQ ID NO: 91 - protein, 60 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIXHHTFYNELRVAPEEXXXXXXXXXXXXXXXXXXXX

SEQ ID NO: 92 - protein, 60 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWXHTFYNELRVAPEEXXXXXXXXXXXXXXXXXXXX

SEQ ID NO: 93 - protein, 60 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHXTFYNELRVAPEEXXXXXXXXXXXXXXXXXXXX

SEQ ID NO: 94 - protein, 60 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHHXFYNELRVAPEEXXXXXXXXXXXXXXXXXXXX

SEQ ID NO: 95 - protein, 60 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHHTXYNELRVAPEEXXXXXXXXXXXXXXXXXXXX

SEQ ID NO: 96 - protein, 60 aa, Artificial Sequence
  synthetic peptide
  MISC_FEATURE (1)..(20): Xaa may be Gly, Ala, or absent.
  MISC_FEATURE (31)..(31): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHHTFXNELRVAPEEXXXXXXXXXXXXXXXXXXXX

SEQ ID NO: 97 - protein, 60 aa, Artificial Sequence
  synthetic peptide
  MISC_FEATURE (1)..(20): Xaa may be Gly, Ala, or absent.
  MISC_FEATURE (32)..(32): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHHTFYXELRVAPEEXXXXXXXXXXXXXXXXXXXX

SEQ ID NO: 98 - protein, 60 aa, Artificial Sequence
  synthetic peptide
  MISC_FEATURE (1)..(20): Xaa may be Gly, Ala, or absent.
  MISC_FEATURE (33)..(33): Xaa may be any naturally-occurring amino acid or any unnatural amino acid.
  MISC_FEATURE (41)..(60): Xaa may be Gly, Ala, or absent.
XXXXXXXXXXXXXXXXXXXXDMEKIWHHTFYNXLRVAPEEXXXXXXXXXXXXXXXXXXXX

SEQ ID NO: 99 - protein, 80 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (61)..(80): Xaa may be Gly, Ala, or absent.
XXXXXXXXXXXXXXXXXXXXXEHGIVTNWDDMEKIWHHTFYNELRVAPEEHPVLLTEAPLXXXXXXXXXXXXXXXXXXXX

SEQ ID NO: 100 - protein, 80 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (61)..(80): Xaa may be Gly, Ala, or absent.
XXXXXXXXXXXXXXXXXXXXIXHGIVTNWDDMEKIWHHTFYNELRVAPEEHPVLLTEAPLXXXXXXXXXXXXXXXXXXXX

SEQ ID NO: 101 - protein, 80 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (61)..(80): Xaa may be Gly, Ala, or absent.
XXXXXXXXXXXXXXXXXXXXIEXGIVTNWDDMEKIWHHTFYNELRVAPEEHPVLLTEAPLXXXXXXXXXXXXXXXXXXXX

SEQ ID NO: 102 - protein, 80 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHXIVTNWDDMEKIWHHTFYNELRVAPEEHPVLLTEAPLXXXXXXXXXXXXXXXXXXXX

SEQ ID NO: 103 - protein, 80 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGXVTNWDDMEKIWHHTFYNELRVAPEEHPVLLTEAPLXXXXXXXXXXXXXXXXXXXX

SEQ ID NO: 104 - protein, 80 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIXTNWDDMEKIWHHTFYNELRVAPEEHPVLLTEAPLXXXXXXXXXXXXXXXXXXXX

SEQ ID NO: 105 - protein, 80 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVXNWDDMEKIWHHTFYNELRVAPEEHPVLLTEAPLXXXXXXXXXXXXXXXXXXXX

SEQ ID NO: 106 - protein, 80 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTXWDDMEKIWHHTFYNELRVAPEEHPVLLTEAPLXXXXXXXXXXXXXXXXXXXX

SEQ ID NO: 107 - protein, 80 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNXDDMEKIWHHTFYNELRVAPEEHPVLLTEAPLXXXXXXXXXXXXXXXXXXXX

SEQ ID NO: 108 - protein, 80 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWXDMEKIWHHTFYNELRVAPEEHPVLLTEAPLXXXXXXXXXXXXXXXXXXXX

SEQ ID NO: 109 - protein, 80 aa, Artificial Sequence
  synthetic peptide
  MISC_FEATURE (1)..(20): Xaa may be Gly, Ala, or absent.
  MISC_FEATURE (31)..(31): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDXMEKIWHHTFYNELRVAPEEHPVLLTEAPLXXXXXXXXXXXXXXXXXXXX

SEQ ID NO: 110 - protein, 80 aa, Artificial Sequence
  synthetic peptide
  MISC_FEATURE (1)..(20): Xaa may be Gly, Ala, or absent.
  MISC_FEATURE (32)..(32): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDXEKIWHHTFYNELRVAPEEHPVLLTEAPLXXXXXXXXXXXXXXXXXXXX

SEQ ID NO: 111 - protein, 80 aa, Artificial Sequence
  synthetic peptide
  MISC_FEATURE (1)..(20): Xaa may be Gly, Ala, or absent.
  MISC_FEATURE (33)..(33): Xaa may be any naturally-occurring amino acid or any unnatural amino acid.
  MISC_FEATURE (61)..(81): Xaa may be Gly, Ala, or absent.
XXXXXXXXXXXXXXXXXXXXIEHGIVTNWDDMXKIWHHTFYNELRVAPEEHPVLLTEAPLXXXXXXXXXXXXXXXXXXXX

SEQ ID NO: 112 - protein, 80 aa, Artificial Sequence
  synthetic peptide
  MISC_FEATURE (1)..(20): Xaa may be Gly, Ala, or absent.
  MISC_FEATURE (34)..(34): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEXIWHHTFYNELRVAPEEHPVLLTEAPLXXXXXXXXXXXXXXXXXXXX

SEQ ID NO: 113 - protein, 80 aa, Artificial Sequence
  synthetic peptide
  MISC_FEATURE (1)..(20): Xaa may be Gly, Ala, or absent.
  MISC_FEATURE (35)..(35): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKXWHHTFYNELRVAPEEHPVLLTEAPLXXXXXXXXXXXXXXXXXXXX

SEQ ID NO: 114 - protein, 80 aa, Artificial Sequence
  synthetic peptide
  MISC_FEATURE (1)..(20): Xaa may be Gly, Ala, or absent.
  MISC_FEATURE (36)..(36): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIXHHTFYNELRVAPEEHPVLLTEAPLXXXXXXXXXXXXXXXXXXXX

SEQ ID NO: 115 - protein, 80 aa, Artificial Sequence
  synthetic peptide
  MISC_FEATURE (1)..(20): Xaa may be Gly, Ala, or absent.
  MISC_FEATURE (37)..(37): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWXHTFYNELRVAPEEHPVLLTEAPLXXXXXXXXXXXXXXXXXXXX

SEQ ID NO: 116 - protein, 80 aa, Artificial Sequence
  synthetic peptide
  MISC_FEATURE (1)..(20): Xaa may be Gly, Ala, or absent.
  MISC_FEATURE (38)..(38): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHXTFYNELRVAPEEHPVLLTEAPLXXXXXXXXXXXXXXXXXXXX

SEQ ID NO: 117 - protein, 80 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHXFYNELRVAPEEHPVLLTEAPLXXXXXXXXXXXXXXXXXXXX

SEQ ID NO: 118 - protein, 80 aa, Artificial Sequence
  synthetic peptide
  MISC_FEATURE (1)..(20): Xaa may be Gly, Ala, or absent.
  MISC_FEATURE (40)..(40): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTXYNELRVAPEEHPVLLTEAPLXXXXXXXXXXXXXXXXXXXX

SEQ ID NO: 119 - protein, 80 aa, Artificial Sequence
  synthetic peptide
  MISC_FEATURE (1)..(20): Xaa may be Gly, Ala, or absent.
  MISC_FEATURE (41)..(41): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFXNELRVAPEEHPVLLTEAPLXXXXXXXXXXXXXXXXXXXX

SEQ ID NO: 120 - protein, 80 aa, Artificial Sequence
  synthetic peptide
  MISC_FEATURE (1)..(20): Xaa may be Gly, Ala, or absent.
  MISC_FEATURE (42)..(42): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYXELRVAPEEHPVLLTEAPLXXXXXXXXXXXXXXXXXXXX

SEQ ID NO: 121 - protein, 80 aa, Artificial Sequence
  synthetic peptide
  MISC_FEATURE (1)..(20): Xaa may be Gly, Ala, or absent.
  MISC_FEATURE (43)..(43): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNXLRVAPEEHPVLLTEAPLXXXXXXXXXXXXXXXXXXXX

SEQ ID NO: 122 - protein, 80 aa, Artificial Sequence
  synthetic peptide
  MISC_FEATURE (1)..(20): Xaa may be Gly, Ala, or absent.
  MISC_FEATURE (44)..(44): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNEXRVAPEEHPVLLTEAPLXXXXXXXXXXXXXXXXXXXX

SEQ ID NO: 123 - protein, 80 aa, Artificial Sequence
  synthetic peptide
  MISC_FEATURE (1)..(20): Xaa may be Gly, Ala, or absent.
  MISC_FEATURE (45)..(45): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELXVAPEEHPVLLTEAPLXXXXXXXXXXXXXXXXXXXX

SEQ ID NO: 124 - protein, 80 aa, Artificial Sequence
  synthetic peptide
  MISC_FEATURE (1)..(20): Xaa may be Gly, Ala, or absent.
  MISC_FEATURE (46)..(46): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRXAPEEHPVLLTEAPLXXXXXXXXXXXXXXXXXXXX

SEQ ID NO: 125 - protein, 80 aa, Artificial Sequence
  synthetic peptide
  MISC_FEATURE (1)..(20): Xaa may be Gly, Ala, or absent.
  MISC_FEATURE (47)..(47): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVXPEEHPVLLTEAPLXXXXXXXXXXXXXXXXXXXX

SEQ ID NO: 126 - protein, 80 aa, Artificial Sequence
  synthetic peptide
  MISC_FEATURE (1)..(20): Xaa may be Gly, Ala, or absent.
  MISC_FEATURE (48)..(48): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAXEEHPVLLTEAPLXXXXXXXXXXXXXXXXXXXX

SEQ ID NO: 127 - protein, 80 aa, Artificial Sequence
  synthetic peptide
  MISC_FEATURE (1)..(20): Xaa may be Gly, Ala, or absent.
  MISC_FEATURE (49)..(49): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPXEHPVLLTEAPLXXXXXXXXXXXXXXXXXXXX

SEQ ID NO: 128 - protein, 80 aa, Artificial Sequence
  synthetic peptide
  MISC_FEATURE (1)..(20): Xaa may be Gly, Ala, or absent.
  MISC_FEATURE (50)..(50): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEXHPVLLTEAPLXXXXXXXXXXXXXXXXXXXX

SEQ ID NO: 129 - protein, 80 aa, Artificial Sequence
  synthetic peptide
  MISC_FEATURE (1)..(20): Xaa may be Gly, Ala, or absent.
  MISC_FEATURE (51)..(51): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEXPVLLTEAPLXXXXXXXXXXXXXXXXXXXX

SEQ ID NO: 130 - protein, 80 aa, Artificial Sequence
  synthetic peptide
  MISC_FEATURE (1)..(20): Xaa may be Gly, Ala, or absent.
  MISC_FEATURE (52)..(52): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHXVLLTEAPLXXXXXXXXXXXXXXXXXXXX

SEQ ID NO: 131 - protein, 80 aa, Artificial Sequence
  synthetic peptide
  MISC_FEATURE (1)..(20): Xaa may be Gly, Ala, or absent.
  MISC_FEATURE (53)..(53): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPXLLTEAPLXXXXXXXXXXXXXXXXXXXX

SEQ ID NO: 132 - protein, 80 aa, Artificial Sequence
  synthetic peptide
  MISC_FEATURE (1)..(20): Xaa may be Gly, Ala, or absent.
  MISC_FEATURE (54)..(54): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVXLTEAPLXXXXXXXXXXXXXXXXXXXX

SEQ ID NO: 133 - protein, 80 aa, Artificial Sequence
  synthetic peptide
  MISC_FEATURE (1)..(20): Xaa may be Gly, Ala, or absent.
  MISC_FEATURE (55)..(55): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLXTEAPLXXXXXXXXXXXXXXXXXXXX

SEQ ID NO: 134 - protein, 80 aa, Artificial Sequence
  synthetic peptide
  MISC_FEATURE (1)..(20): Xaa may be Gly, Ala, or absent.
  MISC_FEATURE (56)..(56): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLLXEAPLXXXXXXXXXXXXXXXXXXXX

SEQ ID NO: 135 - protein, 80 aa, Artificial Sequence
  synthetic peptide
  MISC_FEATURE (1)..(20): Xaa may be Gly, Ala, or absent.
  MISC_FEATURE (57)..(57): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLLTXAPLXXXXXXXXXXXXXXXXXXXX

SEQ ID NO: 136 - protein, 80 aa, Artificial Sequence
  synthetic peptide
  MISC_FEATURE (1)..(20): Xaa may be Gly, Ala, or absent.
  MISC_FEATURE (58)..(58): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLLTEXPLXXXXXXXXXXXXXXXXXXXX

SEQ ID NO: 137 - protein, 80 aa, Artificial Sequence
  synthetic peptide
  MISC_FEATURE (1)..(20): Xaa may be Gly, Ala, or absent.
  MISC_FEATURE (59)..(59): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLLTEAXLXXXXXXXXXXXXXXXXXXXX

SEQ ID NO: 138 - protein, 80 aa, Artificial Sequence
  synthetic peptide
  MISC_FEATURE (1)..(20): Xaa may be Gly, Ala, or absent.
  MISC_FEATURE (60)..(60): Xaa may be any naturally-occurring amino acid or any unnatural amino acid.
  MISC_FEATURE (61)..(80): Xaa may be Gly, Ala, or absent.
XXXXXXXXXXXXXXXXXXXXIEHGIVTNWDDMEKIWHHTFYNELRVAPEEHPVLLTEAPXXXXXXXXXXXXXXXXXXXXX

SEQ ID NO: 139 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (21)..(21): Xaa may be any naturally-occurring amino acid or any unnatural amino acid.
  MISC_FEATURE (31)..(50): Xaa may be any naturally-occurring amino acid or any unnatural amino acid or absent.
XXXXXXXXXXXXXXXXXXXXXIMFETFNTPXXXXXXXXXXXXXXXXXXXX

SEQ ID NO: 140 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXQXMFETFNTPXXXXXXXXXXXXXXXXXXXX

SEQ ID NO: 141 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXQIXFETFNTPXXXXXXXXXXXXXXXXXXXX

SEQ ID NO: 142 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMXETFNTPXXXXXXXXXXXXXXXXXXXX

SEQ ID NO: 143 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFXTFNTPXXXXXXXXXXXXXXXXXXXX

SEQ ID NO: 144 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFEXFNTPXXXXXXXXXXXXXXXXXXXX

SEQ ID NO: 145 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFETXNTPXXXXXXXXXXXXXXXXXXXX

SEQ ID NO: 146 - protein, 50 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFETFXTPXXXXXXXXXXXXXXXXXXXX

SEQ ID NO: 147 - protein, 50 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFETFNXPXXXXXXXXXXXXXXXXXXXX

SEQ ID NO: 148 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXQIMFETFNTXXXXXXXXXXXXXXXXXXXXX

SEQ ID NO: 149 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (24)..(24): Xaa may be any naturally-occurring amino acid or any unnatural amino acid.
  MISC_FEATURE (31)..(50): Xaa may be any naturally-occurring amino acid or any unnatural amino acid or absent.
XXXXXXXXXXXXXXXXXXXXTFNXPAMYVAXXXXXXXXXXXXXXXXXXXX

SEQ ID NO: 150 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXXFNXPAMYVAXXXXXXXXXXXXXXXXXXXX

SEQ ID NO: 151 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXTXNXPAMYVAXXXXXXXXXXXXXXXXXXXX

SEQ ID NO: 152 - protein, 50 aa, Artificial Sequence
  synthetic peptide
  MISC_FEATURE (1)..(20): Xaa may be Gly, Ala, or absent.
  MISC_FEATURE (23)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXTFXXPAMYVAXXXXXXXXXXXXXXXXXXXX

SEQ ID NO: 153 - protein, 50 aa, Artificial Sequence
  synthetic peptide
  MISC_FEATURE (1)..(20): Xaa may be Gly, Ala, or absent.
  MISC_FEATURE (24)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXTFNXXAMYVAXXXXXXXXXXXXXXXXXXXX

SEQ ID NO: 154 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXTFNXPXMYVAXXXXXXXXXXXXXXXXXXXX

SEQ ID NO: 155 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXTFNXPAXYVAXXXXXXXXXXXXXXXXXXXX

SEQ ID NO: 156 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXTFNXPAMXVAXXXXXXXXXXXXXXXXXXXX

SEQ ID NO: 157 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXTFNXPAMYXAXXXXXXXXXXXXXXXXXXXX

SEQ ID NO: 158 - protein, 50 aa, Artificial Sequence
  synthetic peptide
  MISC_FEATURE (1)..(20): Xaa may be any naturally-occurring amino acid or any unnatural amino acid.
  MISC_FEATURE (24)..(24): Xaa may be any naturally-occurring amino acid or any unnatural amino acid.
  MISC_FEATURE (30)..(30): Xaa may be any naturally-occurring amino acid or any unnatural amino acid.
  MISC_FEATURE (31)..(50): Xaa may be any naturally-occurring amino acid or any unnatural amino acid.
XXXXXXXXXXXXXXXXXXXXTFNXPAMYVXXXXXXXXXXXXXXXXXXXXX

SEQ ID NO: 159 - protein, 50 aa, Artificial Sequence; identical to SEQ ID NO: 65
  synthetic peptide
  MISC_FEATURE (1)..(20): Xaa may be Gly, Ala, or absent.
  MISC_FEATURE (31)..(50): Xaa may be Gly, Ala, or absent.

SEQ ID NO: 160 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXEAPLNPKANRXXXXXXXXXXXXXXXXXXXX

SEQ ID NO: 161 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXAPLNPKANREXXXXXXXXXXXXXXXXXXXX

SEQ ID NO: 162 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXPLNPKANREKXXXXXXXXXXXXXXXXXXXX

SEQ ID NO: 163 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLNPKANREKMXXXXXXXXXXXXXXXXXXXX

SEQ ID NO: 164 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXNPKANREKMTXXXXXXXXXXXXXXXXXXXX

SEQ ID NO: 165 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXPKANREKMTQXXXXXXXXXXXXXXXXXXXX

SEQ ID NO: 166 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXKANREKMTQIXXXXXXXXXXXXXXXXXXXX

SEQ ID NO: 167 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXANREKMTQIMXXXXXXXXXXXXXXXXXXXX

SEQ ID NO: 168 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXNREKMTQIMFXXXXXXXXXXXXXXXXXXXX

SEQ ID NO: 169 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXREKMTQIMFEXXXXXXXXXXXXXXXXXXXX

SEQ ID NO: 170 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXEKMTQIMFETXXXXXXXXXXXXXXXXXXXX

SEQ ID NO: 171 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXKMTQIMFETFXXXXXXXXXXXXXXXXXXXX

SEQ ID NO: 172 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXMTQIMFETFNXXXXXXXXXXXXXXXXXXXX

SEQ ID NO: 173 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXTQIMFETFNXXXXXXXXXXXXXXXXXXXXX

SEQ ID NO: 174 - protein, 50 aa, Artificial Sequence; identical to SEQ ID NO: 147
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(50): Xaa may be Gly, Ala, or absent.

SEQ ID NO: 175 - protein, 50 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXIMFETFNXPAXXXXXXXXXXXXXXXXXXXX

SEQ ID NO: 176 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXMFETFNXPAMXXXXXXXXXXXXXXXXXXXX

SEQ ID NO: 177 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXFETFNXPAMYXXXXXXXXXXXXXXXXXXXX

SEQ ID NO: 178 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXETFNXPAMYVXXXXXXXXXXXXXXXXXXXX

SEQ ID NO: 179 - protein, 50 aa, Artificial Sequence; identical to SEQ ID NO: 149
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.

SEQ ID NO: 180 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXFNXPAMYVAIXXXXXXXXXXXXXXXXXXXX

SEQ ID NO: 181 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXNXPAMYVAIQXXXXXXXXXXXXXXXXXXXX

SEQ ID NO: 182 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXPAMYVAIQAXXXXXXXXXXXXXXXXXXXX

SEQ ID NO: 183 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXPAMYVAIQAVXXXXXXXXXXXXXXXXXXXX

SEQ ID NO: 184 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXAMYVAIQAVLXXXXXXXXXXXXXXXXXXXX

SEQ ID NO: 185 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXMYVAIQAVLSXXXXXXXXXXXXXXXXXXXX

SEQ ID NO: 186 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXYVAIQAVLSLXXXXXXXXXXXXXXXXXXXX

SEQ ID NO: 187 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXVAIQAVLSLYXXXXXXXXXXXXXXXXXXXX

SEQ ID NO: 188 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXAIQAVLSLYAXXXXXXXXXXXXXXXXXXXX

SEQ ID NO: 189 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXIQAVLSLYASXXXXXXXXXXXXXXXXXXXX

SEQ ID NO: 190 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXQAVLSLYASGXXXXXXXXXXXXXXXXXXXX

SEQ ID NO: 191 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXTEAPLNPKANREKMTQIMFEXXXXXXXXXXXXXXXXXXXX

SEQ ID NO: 192 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXEAPLNPKANREKMTQIMFETXXXXXXXXXXXXXXXXXXXX

SEQ ID NO: 193 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXAPLNPKANREKMTQIMFETFXXXXXXXXXXXXXXXXXXXX

SEQ ID NO: 194 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXPLNPKANREKMTQIMFETFNXXXXXXXXXXXXXXXXXXXX

SEQ ID NO: 195 - protein, 60 aa, Artificial Sequence
  synthetic peptide
  MISC_FEATURE (1)..(20): Xaa may be Gly, Ala, or absent.
  MISC_FEATURE (40)..(40): Xaa may be any naturally-occurring amino acid or any unnatural amino acid.
  MISC_FEATURE (41)..(60): Xaa may be Gly, Ala, or absent.
XXXXXXXXXXXXXXXXXXXXLNPKANREKMTQIMFETFNXXXXXXXXXXXXXXXXXXXXX

SEQ ID NO: 196 - protein, 60 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFETFNXPXXXXXXXXXXXXXXXXXXXX

SEQ ID NO: 197 - protein, 60 aa, Artificial Sequence
  synthetic peptide
  MISC_FEATURE (1)..(20): Xaa may be Gly, Ala, or absent.
  MISC_FEATURE (38)..(38): Xaa may be any naturally-occurring amino acid or any unnatural amino acid.
  MISC_FEATURE (41)..(60): Xaa may be Gly, Ala, or absent.
XXXXXXXXXXXXXXXXXXXXPKANREKMTQIMFETFNXPAXXXXXXXXXXXXXXXXXXXX

SEQ ID NO: 198 - protein, 60 aa, Artificial Sequence
  synthetic peptide
  MISC_FEATURE (1)..(20): Xaa may be Gly, Ala, or absent.
  MISC_FEATURE (37)..(37): Xaa may be any naturally-occurring amino acid or any unnatural amino acid.
  MISC_FEATURE (41)..(60): Xaa may be Gly, Ala, or absent.
XXXXXXXXXXXXXXXXXXXXKANREKMTQIMFETFNXPAMXXXXXXXXXXXXXXXXXXXX

SEQ ID NO: 199 - protein, 60 aa, Artificial Sequence
  synthetic peptide
  MISC_FEATURE (1)..(20): Xaa may be Gly, Ala, or absent.
  MISC_FEATURE (36)..(36): Xaa may be any naturally-occurring amino acid or any unnatural amino acid.
  MISC_FEATURE (41)..(60): Xaa may be Gly, Ala, or absent.
XXXXXXXXXXXXXXXXXXXXANREKMTQIMFETFNXPAMYXXXXXXXXXXXXXXXXXXXX

SEQ ID NO: 200 - protein, 60 aa, Artificial Sequence
  synthetic peptide
  MISC_FEATURE (1)..(20): Xaa may be Gly, Ala, or absent.
  MISC_FEATURE (35)..(35): Xaa may be any naturally-occurring amino acid or any unnatural amino acid.
  MISC_FEATURE (41)..(60): Xaa may be Gly, Ala, or absent.
XXXXXXXXXXXXXXXXXXXXNREKMTQIMFETFNXPAMYVXXXXXXXXXXXXXXXXXXXX

SEQ ID NO: 201 - protein, 60 aa, Artificial Sequence
  synthetic peptide
  MISC_FEATURE (1)..(20): Xaa may be Gly, Ala, or absent.
  MISC_FEATURE (34)..(34): Xaa may be any naturally-occurring amino acid or any unnatural amino acid.
  MISC_FEATURE (41)..(60): Xaa may be Gly, Ala, or absent.
XXXXXXXXXXXXXXXXXXXXREKMTQIMFETFNXPAMYVAXXXXXXXXXXXXXXXXXXXX

SEQ ID NO: 202 - protein, 60 aa, Artificial Sequence
  synthetic peptide
  MISC_FEATURE (1)..(20): Xaa may be Gly, Ala, or absent.
  MISC_FEATURE (33)..(33): Xaa may be any naturally-occurring amino acid or any unnatural amino acid.
  MISC_FEATURE (41)..(60): Xaa may be Gly, Ala, or absent.
XXXXXXXXXXXXXXXXXXXXEKMTQIMFETFNXPAMYVAIXXXXXXXXXXXXXXXXXXXX

SEQ ID NO: 203 - protein, 60 aa, Artificial Sequence
  synthetic peptide
  MISC_FEATURE (1)..(20): Xaa may be Gly, Ala, or absent.
  MISC_FEATURE (32)..(32): Xaa may be any naturally-occurring amino acid or any unnatural amino acid.
  MISC_FEATURE (41)..(60): Xaa may be Gly, Ala, or absent.
XXXXXXXXXXXXXXXXXXXXKMTQIMFETFNXPAMYVAIQXXXXXXXXXXXXXXXXXXXX

SEQ ID NO: 204 - protein, 60 aa, Artificial Sequence
  synthetic peptide
  MISC_FEATURE (1)..(20): Xaa may be Gly, Ala, or absent.
  MISC_FEATURE (31)..(31): Xaa may be any naturally-occurring amino acid or any unnatural amino acid.
  MISC_FEATURE (41)..(60): Xaa may be Gly, Ala, or absent.
XXXXXXXXXXXXXXXXXXXXMTQIMFETFNXPAMYVAIQAXXXXXXXXXXXXXXXXXXXX

SEQ ID NO: 205 - protein, 60 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (41)..(60): Xaa may be Gly, Ala, or absent.
XXXXXXXXXXXXXXXXXXXXTQIMFETFNXPAMYVAIQAVXXXXXXXXXXXXXXXXXXXX

SEQ ID NO: 206 - protein, 60 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (41)..(60): Xaa may be Gly, Ala, or absent.
XXXXXXXXXXXXXXXXXXXXQIMFETFNXPAMYVAIQAVLXXXXXXXXXXXXXXXXXXXX

SEQ ID NO: 207 - protein, 60 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (41)..(60): Xaa may be Gly, Ala, or absent.
XXXXXXXXXXXXXXXXXXXXIMFETFNXPAMYVAIQAVLSXXXXXXXXXXXXXXXXXXXX

SEQ ID NO: 208 - protein, 60 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (41)..(60): Xaa may be Gly, Ala, or absent.
XXXXXXXXXXXXXXXXXXXXMFETFNXPAMYVAIQAVLSLXXXXXXXXXXXXXXXXXXXX

SEQ ID NO: 209 - protein, 60 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (41)..(60): Xaa may be Gly, Ala, or absent.
XXXXXXXXXXXXXXXXXXXXFETFNXPAMYVAIQAVLSLYXXXXXXXXXXXXXXXXXXXX

SEQ ID NO: 210 - protein, 60 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (41)..(60): Xaa may be Gly, Ala, or absent.
XXXXXXXXXXXXXXXXXXXXETFNXPAMYVAIQAVLSLYAXXXXXXXXXXXXXXXXXXXX

SEQ ID NO: 211 - protein, 60 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (41)..(60): Xaa may be Gly, Ala, or absent.
XXXXXXXXXXXXXXXXXXXXTFNXPAMYVAIQAVLSLYASXXXXXXXXXXXXXXXXXXXX

SEQ ID NO: 212 - protein, 61 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXXQIMFETFNXPAMYVAIQAVLXXXXXXXXXXXXXXXXXXXX

SEQ ID NO: 213 - protein, 61 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQXIMFETFNXPAMYVAIQAVLXXXXXXXXXXXXXXXXXXXX

SEQ ID NO: 214 - protein, 61 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIXMFETFNXPAMYVAIQAVLXXXXXXXXXXXXXXXXXXXX

SEQ ID NO: 215 - protein, 61 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMXFETFNXPAMYVAIQAVLXXXXXXXXXXXXXXXXXXXX

SEQ ID NO: 216 - protein, 61 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFXETFNXPAMYVAIQAVLXXXXXXXXXXXXXXXXXXXX

SEQ ID NO: 217 - protein, 61 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFEXTFNXPAMYVAIQAVLXXXXXXXXXXXXXXXXXXXX

SEQ ID NO: 218 - protein, 61 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETXFNXPAMYVAIQAVLXXXXXXXXXXXXXXXXXXXX

SEQ ID NO: 219 - protein, 61 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (30)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFXNXPAMYVAIQAVLXXXXXXXXXXXXXXXXXXXX

SEQ ID NO: 220 - protein, 61 aa, Artificial Sequence
  synthetic peptide
  MISC_FEATURE (1)..(20): Xaa may be Gly, Ala, or absent.
  MISC_FEATURE (29)..(30): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXXPAMYVAIQAVLXXXXXXXXXXXXXXXXXXXX

SEQ ID NO: 221 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(31): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPXAMYVAIQAVLXXXXXXXXXXXXXXXXXXXX

SEQ ID NO: 222 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (32)..(32): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAXMYVAIQAVLXXXXXXXXXXXXXXXXXXXX

SEQ ID NO: 223 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (33)..(33): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMXYVAIQAVLXXXXXXXXXXXXXXXXXXXX

SEQ ID NO: 224 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (34)..(34): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYXVAIQAVLXXXXXXXXXXXXXXXXXXXX

SEQ ID NO: 225 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (35)..(35): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVXAIQAVLXXXXXXXXXXXXXXXXXXXX

SEQ ID NO: 226 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (36)..(36): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAXIQAVLXXXXXXXXXXXXXXXXXXXX

SEQ ID NO: 227 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (37)..(37): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAIXQAVLXXXXXXXXXXXXXXXXXXXX

SEQ ID NO: 228 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (38)..(38): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAIQXAVLXXXXXXXXXXXXXXXXXXXX

SEQ ID NO: 229 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (39)..(39): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAIQAXVLXXXXXXXXXXXXXXXXXXXX

SEQ ID NO: 230 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (40)..(40): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAIQAVXLXXXXXXXXXXXXXXXXXXXX

SEQ ID NO: 231 - protein, 61 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (41)..(41): Xaa may be any naturally-occurring amino acid or any unnatural amino acid.
  MISC_FEATURE (42)..(61): Xaa may be Gly, Ala, or absent.
XXXXXXXXXXXXXXXXXXXXQIMFETFNXPAMYVAIQAVLXXXXXXXXXXXXXXXXXXXXX

SEQ ID NO: 232 - protein, 81 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXXPKANREKMTQIMFETFNXPAMYVAIQAVLSLYASGRTTGIXXXXXXXXXXXXXXXXXXXX

SEQ ID NO: 233 - protein, 81 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNXKANREKMTQIMFETFNXPAMYVAIQAVLSLYASGRTTGIXXXXXXXXXXXXXXXXXXXX

SEQ ID NO: 234 - protein, 81 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPXANREKMTQIMFETFNXPAMYVAIQAVLSLYASGRTTGIXXXXXXXXXXXXXXXXXXXX

SEQ ID NO: 235 - protein, 81 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKXNREKMTQIMFETFNXPAMYVAIQAVLSLYASGRTTGIXXXXXXXXXXXXXXXXXXXX

SEQ ID NO: 236 - protein, 81 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKAXREKMTQIMFETFNXPAMYVAIQAVLSLYASGRTTGIXXXXXXXXXXXXXXXXXXXX

SEQ ID NO: 237 - protein, 81 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANXEKMTQIMFETFNXPAMYVAIQAVLSLYASGRTTGIXXXXXXXXXXXXXXXXXXXX

SEQ ID NO: 238 - protein, 81 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANRXKMTQIMFETFNXPAMYVAIQAVLSLYASGRTTGIXXXXXXXXXXXXXXXXXXXX

SEQ ID NO: 239 - protein, 81 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREXMTQIMFETFNXPAMYVAIQAVLSLYASGRTTGIXXXXXXXXXXXXXXXXXXXX

SEQ ID NO: 240 - protein, 81 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKXTQIMFETFNXPAMYVAIQAVLSLYASGRTTGIXXXXXXXXXXXXXXXXXXXX

SEQ ID NO: 241 - protein, 81 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMXQIMFETFNXPAMYVAIQAVLSLYASGRTTGIXXXXXXXXXXXXXXXXXXXX

SEQ ID NO: 242 - protein, 81 aa, Artificial Sequence
  synthetic peptide
  MISC_FEATURE (1)..(20): Xaa may be Gly, Ala, or absent.
  MISC_FEATURE (31)..(31): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTXIMFETFNXPAMYVAIQAVLSLYASGRTTGIXXXXXXXXXXXXXXXXXXXX

SEQ ID NO: 243 - protein, 81 aa, Artificial Sequence
  synthetic peptide
  MISC_FEATURE (1)..(20): Xaa may be Gly, Ala, or absent.
  MISC_FEATURE (32)..(32): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQXMFETFNXPAMYVAIQAVLSLYASGRTTGIXXXXXXXXXXXXXXXXXXXX

SEQ ID NO: 244 - protein, 81 aa, Artificial Sequence
  synthetic peptide
  MISC_FEATURE (1)..(20): Xaa may be Gly, Ala, or absent.
  MISC_FEATURE (33)..(33): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIXFETFNXPAMYVAIQAVLSLYASGRTTGIXXXXXXXXXXXXXXXXXXXX

SEQ ID NO: 245 - protein, 81 aa, Artificial Sequence
  synthetic peptide
  MISC_FEATURE (1)..(20): Xaa may be Gly, Ala, or absent.
  MISC_FEATURE (34)..(34): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMXETFNXPAMYVAIQAVLSLYASGRTTGIXXXXXXXXXXXXXXXXXXXX

SEQ ID NO: 246 - protein, 81 aa, Artificial Sequence
  synthetic peptide
  MISC_FEATURE (1)..(20): Xaa may be Gly, Ala, or absent.
  MISC_FEATURE (35)..(35): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFXTFNXPAMYVAIQAVLSLYASGRTTGIXXXXXXXXXXXXXXXXXXXX

SEQ ID NO: 247 - protein, 81 aa, Artificial Sequence
  synthetic peptide
  MISC_FEATURE (1)..(20): Xaa may be Gly, Ala, or absent.
  MISC_FEATURE (36)..(36): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFEXFNXPAMYVAIQAVLSLYASGRTTGIXXXXXXXXXXXXXXXXXXXX

SEQ ID NO: 248 - protein, 81 aa, Artificial Sequence
  synthetic peptide
  MISC_FEATURE (1)..(20): Xaa may be any naturally-occurring amino acid or any unnatural amino acid.
  MISC_FEATURE (37)..(37): Xaa may be any naturally-occurring amino acid or any unnatural amino acid.
  MISC_FEATURE (39)..(39): Xaa may be any naturally-occurring amino acid or any unnatural amino acid.
  MISC_FEATURE (62)..(81): Xaa may be any naturally-occurring amino acid or any unnatural amino acid.
XXXXXXXXXXXXXXXXXXXXNPKANREKMTQIMFETXNXPAMYVAIQAVLSLYASGRTTGIXXXXXXXXXXXXXXXXXXXX

SEQ ID NO: 249 - protein, 81 aa, Artificial Sequence
  synthetic peptide
  MISC_FEATURE (1)..(20): Xaa may be Gly, Ala, or absent.
  MISC_FEATURE (38)..(39): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFXXPAMYVAIQAVLSLYASGRTTGIXXXXXXXXXXXXXXXXXXXX

SEQ ID NO: 250 - protein, 81 aa, Artificial Sequence
  synthetic peptide
  MISC_FEATURE (1)..(20): Xaa may be Gly, Ala, or absent.
  MISC_FEATURE (39)..(40): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXXAMYVAIQAVLSLYASGRTTGIXXXXXXXXXXXXXXXXXXXX

SEQ ID NO: 251 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (41)..(41): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPXMYVAIQAVLSLYASGRTTGIXXXXXXXXXXXXXXXXXXXX

SEQ ID NO: 252 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (42)..(42): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAXYVAIQAVLSLYASGRTTGIXXXXXXXXXXXXXXXXXXXX

SEQ ID NO: 253 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (43)..(43): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMXVAIQAVLSLYASGRTTGIXXXXXXXXXXXXXXXXXXXX

SEQ ID NO: 254 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (44)..(44): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYXAIQAVLSLYASGRTTGIXXXXXXXXXXXXXXXXXXXX

SEQ ID NO: 255 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (45)..(45): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVXIQAVLSLYASGRTTGIXXXXXXXXXXXXXXXXXXXX

SEQ ID NO: 256 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (46)..(46): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAXQAVLSLYASGRTTGIXXXXXXXXXXXXXXXXXXXX

SEQ ID NO: 257 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (47)..(47): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIXAVLSLYASGRTTGIXXXXXXXXXXXXXXXXXXXX

SEQ ID NO: 258 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (48)..(48): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQXVLSLYASGRTTGIXXXXXXXXXXXXXXXXXXXX

SEQ ID NO: 259 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (49)..(49): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAXLSLYASGRTTGIXXXXXXXXXXXXXXXXXXXX

SEQ ID NO: 260 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (50)..(50): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVXSLYASGRTTGIXXXXXXXXXXXXXXXXXXXX

SEQ ID NO: 261 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (51)..(51): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLXLYASGRTTGIXXXXXXXXXXXXXXXXXXXX

SEQ ID NO: 262 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (52)..(52): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSXYASGRTTGIXXXXXXXXXXXXXXXXXXXX

SEQ ID NO: 263 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (53)..(53): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLXASGRTTGIXXXXXXXXXXXXXXXXXXXX

SEQ ID NO: 264 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (54)..(54): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYXSGRTTGIXXXXXXXXXXXXXXXXXXXX

SEQ ID NO: 265 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (55)..(55): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYAXGRTTGIXXXXXXXXXXXXXXXXXXXX

SEQ ID NO: 266 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (56)..(56): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASXRTTGIXXXXXXXXXXXXXXXXXXXX

SEQ ID NO: 267 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (57)..(57): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASGXTTGIXXXXXXXXXXXXXXXXXXXX

SEQ ID NO: 268 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (58)..(58): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASGRXTGIXXXXXXXXXXXXXXXXXXXX

SEQ ID NO: 269 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (59)..(59): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASGRTXGIXXXXXXXXXXXXXXXXXXXX

SEQ ID NO: 270 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (60)..(60): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASGRTTXIXXXXXXXXXXXXXXXXXXXX

SEQ ID NO: 271 - protein, 81 aa, Artificial Sequence
  synthetic peptide
  MISC_FEATURE (1)..(20): Xaa may be Gly, Ala, or absent.
  MISC_FEATURE (39)..(39): Xaa may be any naturally-occurring amino acid or any unnatural amino acid.
  MISC_FEATURE (61)..(61): Xaa may be any naturally-occurring amino acid or any unnatural amino acid.
  MISC_FEATURE (62)..(81): Xaa may be Gly, Ala, or absent.
XXXXXXXXXXXXXXXXXXXXNPKANREKMTQIMFETFNXPAMYVAIQAVLSLYASGRTTGXXXXXXXXXXXXXXXXXXXXX

SEQ ID NO: 272 - protein, 60 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXXPKANREKMTQIMFETFNXPXXXXXXXXXXXXXXXXXXXX

SEQ ID NO: 273 - protein, 60 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNXKANREKMTQIMFETFNXPXXXXXXXXXXXXXXXXXXXX

SEQ ID NO: 274 - protein, 60 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPXANREKMTQIMFETFNXPXXXXXXXXXXXXXXXXXXXX

SEQ ID NO: 275 - protein, 60 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKXNREKMTQIMFETFNXPXXXXXXXXXXXXXXXXXXXX

SEQ ID NO: 276 - protein, 60 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKAXREKMTQIMFETFNXPXXXXXXXXXXXXXXXXXXXX

SEQ ID NO: 277 - protein, 60 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANXEKMTQIMFETFNXPXXXXXXXXXXXXXXXXXXXX

SEQ ID NO: 278 - protein, 60 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANRXKMTQIMFETFNXPXXXXXXXXXXXXXXXXXXXX

SEQ ID NO: 279 - protein, 60 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREXMTQIMFETFNXPXXXXXXXXXXXXXXXXXXXX

SEQ ID NO: 280 - protein, 60 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKXTQIMFETFNXPXXXXXXXXXXXXXXXXXXXX

SEQ ID NO: 281 - protein, 60 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMXQIMFETFNXPXXXXXXXXXXXXXXXXXXXX

SEQ ID NO: 282 - protein, 60 aa, Artificial Sequence
  synthetic peptide
  MISC_FEATURE (1)..(20): Xaa may be Gly, Ala, or absent.
  MISC_FEATURE (31)..(31): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTXIMFETFNXPXXXXXXXXXXXXXXXXXXXX

SEQ ID NO: 283 - protein, 60 aa, Artificial Sequence
  synthetic peptide
  MISC_FEATURE (1)..(20): Xaa may be Gly, Ala, or absent.
  MISC_FEATURE (32)..(32): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQXMFETFNXPXXXXXXXXXXXXXXXXXXXX

SEQ ID NO: 284 - protein, 60 aa, Artificial Sequence
  synthetic peptide
  MISC_FEATURE (1)..(20): Xaa may be Gly, Ala, or absent.
  MISC_FEATURE (33)..(33): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIXFETFNXPXXXXXXXXXXXXXXXXXXXX

SEQ ID NO: 285 - protein, 60 aa, Artificial Sequence
  synthetic peptide
  MISC_FEATURE (1)..(20): Xaa may be Gly, Ala, or absent.
  MISC_FEATURE (34)..(34): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMXETFNXPXXXXXXXXXXXXXXXXXXXX

SEQ ID NO: 286 - protein, 60 aa, Artificial Sequence
  synthetic peptide
  MISC_FEATURE (1)..(20): Xaa may be Gly, Ala, or absent.
  MISC_FEATURE (35)..(35): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFXTFNXPXXXXXXXXXXXXXXXXXXXX

SEQ ID NO: 287 - protein, 60 aa, Artificial Sequence
  synthetic peptide
  MISC_FEATURE (1)..(20): Xaa may be Gly, Ala, or absent.
  MISC_FEATURE (36)..(36): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFEXFNXPXXXXXXXXXXXXXXXXXXXX

SEQ ID NO: 288 - protein, 60 aa, Artificial Sequence
  synthetic peptide
  MISC_FEATURE (1)..(20): Xaa may be Gly, Ala, or absent.
  MISC_FEATURE (37)..(37): Xaa may be any naturally-occurring amino acid or any unnatural amino acid.
  MISC_FEATURE (39)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFETXNXPXXXXXXXXXXXXXXXXXXXX

SEQ ID NO: 289 - protein, 60 aa, Artificial Sequence
  synthetic peptide
  MISC_FEATURE (1)..(20): Xaa may be Gly, Ala, or absent.
  MISC_FEATURE (38)..(39): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFETFXXPXXXXXXXXXXXXXXXXXXXX

SEQ ID NO: 290 - protein, 60 aa, Artificial Sequence
  synthetic peptide
  MISC_FEATURE (1)..(20): Xaa may be Gly, Ala, or absent.
  MISC_FEATURE (39)..(40): Xaa may be any naturally-occurring amino acid or any unnatural amino acid.
  MISC_FEATURE (41)..(60): Xaa may be Gly, Ala, or absent.
XXXXXXXXXXXXXXXXXXXXNPKANREKMTQIMFETFNXXXXXXXXXXXXXXXXXXXXXX

SEQ ID NO: 291 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (21)..(21): Xaa may be any naturally-occurring amino acid or any unnatural amino acid.
  MISC_FEATURE (31)..(50): Xaa may be any naturally-occurring amino acid or any unnatural amino acid or absent.
XXXXXXXXXXXXXXXXXXXXXPHAILRLDLXXXXXXXXXXXXXXXXXXXX

SEQ ID NO: 292 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXLXHAILRLDLXXXXXXXXXXXXXXXXXXXX

SEQ ID NO: 293 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXLPXAILRLDLXXXXXXXXXXXXXXXXXXXX

SEQ ID NO: 294 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHXILRLDLXXXXXXXXXXXXXXXXXXXX

SEQ ID NO: 295 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHAXLRLDLXXXXXXXXXXXXXXXXXXXX

SEQ ID NO: 296 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHAIXRLDLXXXXXXXXXXXXXXXXXXXX

SEQ ID NO: 297 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHAILXLDLXXXXXXXXXXXXXXXXXXXX

SEQ ID NO: 298 - protein, 50 aa, Artificial Sequence
  synthetic peptide
  MISC_FEATURE (1)..(20): Xaa may be Gly, Ala, or absent.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHAILRLXLXXXXXXXXXXXXXXXXXXXX

SEQ ID NO: 299 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXLPHAILRLDXXXXXXXXXXXXXXXXXXXXX

SEQ ID NO: 300 - protein, 50 aa, Artificial Sequence
  synthetic peptide
  MISC_FEATURE (1)..(20): Xaa may be any naturally-occurring amino acid or any unnatural amino acid or absent.
  MISC_FEATURE (21)..(21): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be any naturally-occurring amino acid or any unnatural amino acid or absent.
XXXXXXXXXXXXXXXXXXXXXYALPHAIXRXXXXXXXXXXXXXXXXXXXX

SEQ ID NO: 301 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGXALPHAIXRXXXXXXXXXXXXXXXXXXXX

SEQ ID NO: 302 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYXLPHAIXRXXXXXXXXXXXXXXXXXXXX

SEQ ID NO: 303 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYAXPHAIXRXXXXXXXXXXXXXXXXXXXX

SEQ ID NO: 304 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYALXHAIXRXXXXXXXXXXXXXXXXXXXX

SEQ ID NO: 305 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYALPXAIXRXXXXXXXXXXXXXXXXXXXX

SEQ ID NO: 306 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYALPHXIXRXXXXXXXXXXXXXXXXXXXX

SEQ ID NO: 307 - protein, 50 aa, Artificial Sequence
  synthetic peptide
  MISC_FEATURE (1)..(20): Xaa may be Gly, Ala, or absent.
  MISC_FEATURE (28)..(29): Xaa may be any naturally-occurring amino acid or any unnatural amino acid.
  MISC_FEATURE (31)..(50): Xaa may be Gly, Ala, or absent.
XXXXXXXXXXXXXXXXXXXXGYALPHAXXRXXXXXXXXXXXXXXXXXXXX

SEQ ID NO: 308 - protein, 50 aa, Artificial Sequence
  synthetic peptide
  MISC_FEATURE (1)..(20): Xaa may be Gly, Ala, or absent.
  MISC_FEATURE (29)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXGYALPHAIXXXXXXXXXXXXXXXXXXXXXX

SEQ ID NO: 309 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXGDGVTHXVPIXXXXXXXXXXXXXXXXXXXX

SEQ ID NO: 310 - protein, 50 aa, Artificial Sequence
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.
XXXXXXXXXXXXXXXXXXXXDGVTHXVPIYXXXXXXXXXXXXXXXXXXXX

SEQ ID NO: 311 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXGVTHXVPIYEXXXXXXXXXXXXXXXXXXXX

SEQ ID NO: 312 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXVTHXVPIYEGXXXXXXXXXXXXXXXXXXXX

SEQ ID NO: 313 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXTHXVPIYEGYXXXXXXXXXXXXXXXXXXXX

SEQ ID NO: 314 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXHXVPIYEGYAXXXXXXXXXXXXXXXXXXXX

SEQ ID NO: 315 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXVPIYEGYALXXXXXXXXXXXXXXXXXXXX

SEQ ID NO: 316 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXPIYEGYALPXXXXXXXXXXXXXXXXXXXX

SEQ ID NO: 317 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXIYEGYALPHXXXXXXXXXXXXXXXXXXXX

SEQ ID NO: 318 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXYEGYALPHAXXXXXXXXXXXXXXXXXXXX

SEQ ID NO: 319 - protein, 50 aa, Artificial Sequence
  synthetic peptide
  MISC_FEATURE (1)..(20): Xaa may be Gly, Ala, or absent.
  MISC_FEATURE (21)..(21): Xaa may be any naturally-occurring amino acid or any unnatural amino acid.
  MISC_FEATURE (31)..(50): Xaa may be Gly, Ala, or absent.
XXXXXXXXXXXXXXXXXXXXXEGYALPHAIXXXXXXXXXXXXXXXXXXXX

SEQ ID NO: 320 - protein, 50 aa, Artificial Sequence
  synthetic peptide
  MISC_FEATURE (1)..(20): Xaa may be Gly, Ala, or absent.
  MISC_FEATURE (30)..(30): Xaa may be any naturally-occurring amino acid or any unnatural amino acid.
  MISC_FEATURE (31)..(50): Xaa may be Gly, Ala, or absent.
XXXXXXXXXXXXXXXXXXXXEGYALPHAIXXXXXXXXXXXXXXXXXXXXX

SEQ ID NO: 321 - protein, 50 aa, Artificial Sequence
  synthetic peptide
  MISC_FEATURE (1)..(20): Xaa may be any naturally-occurring amino acid or any unnatural amino acid.
  MISC_FEATURE (29)..(29): Xaa may be any naturally-occurring amino acid or any unnatural amino acid.
  MISC_FEATURE (31)..(50): Xaa may be any naturally-occurring amino acid or any unnatural amino acid.
XXXXXXXXXXXXXXXXXXXXGYALPHAIXRXXXXXXXXXXXXXXXXXXXX

SEQ ID NO: 322 - protein, 50 aa, Artificial Sequence
  synthetic peptide
  MISC_FEATURE (1)..(20): Xaa may be Gly, Ala, or absent.
  MISC_FEATURE (28)..(28): Xaa may be any naturally-occurring amino acid or any unnatural amino acid.
  MISC_FEATURE (31)..(50): Xaa may be Gly, Ala, or absent.
XXXXXXXXXXXXXXXXXXXXYALPHAIXRLXXXXXXXXXXXXXXXXXXXX

SEQ ID NO: 323 - protein, 50 aa, Artificial Sequence
  synthetic peptide
  MISC_FEATURE (1)..(20): Xaa may be Gly, Ala, or absent.
  MISC_FEATURE (27)..(27): Xaa may be any naturally-occurring amino acid or any unnatural amino acid.
  MISC_FEATURE (31)..(50): Xaa may be Gly, Ala, or absent.
XXXXXXXXXXXXXXXXXXXXALPHAIXRLDXXXXXXXXXXXXXXXXXXXX

SEQ ID NO: 324 - protein, 50 aa, Artificial Sequence; identical to SEQ ID NO: 296
  synthetic peptide
  MISC_FEATURE (1)..(20): Xaa may be Gly, Ala, or absent.
  MISC_FEATURE (26)..(26): Xaa may be any naturally-occurring amino acid or any unnatural amino acid.
  MISC_FEATURE (31)..(50): Xaa may be Gly, Ala, or absent.

SEQ ID NO: 325 - protein, 50 aa, Artificial Sequence
  synthetic peptide
  MISC_FEATURE (1)..(20): Xaa may be Gly, Ala, or absent.
  MISC_FEATURE (25)..(25): Xaa may be any naturally-occurring amino acid or any unnatural amino acid.
  MISC_FEATURE (31)..(50): Xaa may be Gly, Ala, or absent.
XXXXXXXXXXXXXXXXXXXXPHAIXRLDLAXXXXXXXXXXXXXXXXXXXX

SEQ ID NO: 326 - protein, 50 aa, Artificial Sequence
  synthetic peptide
  MISC_FEATURE (1)..(20): Xaa may be Gly, Ala, or absent.
  MISC_FEATURE (24)..(24): Xaa may be any naturally-occurring amino acid or any unnatural amino acid.
  MISC_FEATURE (31)..(50): Xaa may be Gly, Ala, or absent.
XXXXXXXXXXXXXXXXXXXXHAIXRLDLAGXXXXXXXXXXXXXXXXXXXX

SEQ ID NO: 327 - protein, 50 aa, Artificial Sequence
  synthetic peptide
  MISC_FEATURE (1)..(20): Xaa may be Gly, Ala, or absent.
  MISC_FEATURE (23)..(23): Xaa may be any naturally-occurring amino acid or any unnatural amino acid.
  MISC_FEATURE (31)..(50): Xaa may be Gly, Ala, or absent.
XXXXXXXXXXXXXXXXXXXXAIXRLDLAGRXXXXXXXXXXXXXXXXXXXX

SEQ ID NO: 328 - protein, 50 aa, Artificial Sequence
  synthetic peptide
  MISC_FEATURE (1)..(20): Xaa may be Gly, Ala, or absent.
  MISC_FEATURE (22)..(22): Xaa may be any naturally-occurring amino acid or any unnatural amino acid.
  MISC_FEATURE (31)..(50): Xaa may be Gly, Ala, or absent.
XXXXXXXXXXXXXXXXXXXXIXRLDLAGRDXXXXXXXXXXXXXXXXXXXX

SEQ ID NO: 329 - protein, 50 aa, Artificial Sequence
  synthetic peptide
  MISC_FEATURE (1)..(20): Xaa may be any naturally-occurring amino acid or any unnatural amino acid.
  MISC_FEATURE (21)..(21): Xaa may be any naturally-occurring amino acid or any unnatural amino acid.
  MISC_FEATURE (31)..(50): Xaa may be any naturally-occurring amino acid or any unnatural amino acid.
XXXXXXXXXXXXXXXXXXXXXRLDLAGRDLXXXXXXXXXXXXXXXXXXXX

SEQ ID NO: 330 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLDLAGRDLTDXXXXXXXXXXXXXXXXXXXX

SEQ ID NO: 331 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXDLAGRDLTDYXXXXXXXXXXXXXXXXXXXX

SEQ ID NO: 332 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLAGRDLTDYLXXXXXXXXXXXXXXXXXXXX

SEQ ID NO: 333 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXAGRDLTDYLMXXXXXXXXXXXXXXXXXXXX

SEQ ID NO: 334 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXGRDLTDYLMKXXXXXXXXXXXXXXXXXXXX

SEQ ID NO: 335 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXRDLTDYLMKIXXXXXXXXXXXXXXXXXXXX

SEQ ID NO: 336 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXDLTDYLMKILXXXXXXXXXXXXXXXXXXXX

SEQ ID NO: 337 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLTDYLMKILTXXXXXXXXXXXXXXXXXXXX

SEQ ID NO: 338 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXTDYLMKILTEXXXXXXXXXXXXXXXXXXXX

SEQ ID NO: 339 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXDYLMKILTERXXXXXXXXXXXXXXXXXXXX

SEQ ID NO: 340 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXYLMKILTERGXXXXXXXXXXXXXXXXXXXX

SEQ ID NO: 341 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXLMKILTERGYXXXXXXXXXXXXXXXXXXXX

SEQ ID NO: 342 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXMKILTERGYSXXXXXXXXXXXXXXXXXXXX

SEQ ID NO: 343 - protein, 50 aa, Artificial Sequence
  synthetic peptide
  MISC_FEATURE (1)..(20): Xaa may be Gly, Ala, or absent.
  MISC_FEATURE (31)..(50): Xaa may be Gly, Ala, or absent.
XXXXXXXXXXXXXXXXXXXXKILTERGYSFXXXXXXXXXXXXXXXXXXXX

SEQ ID NO: 344 - protein, 61 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (35)..(35): Xaa may be any natural amino acid or any unnatural amino acid.
  MISC_FEATURE (42)..(61): Xaa may be Gly, Ala, or absent.
XXXXXXXXXXXXXXXXXXXXXVPIYEGYALPHAIXRLDLAGXXXXXXXXXXXXXXXXXXXX

SEQ ID NO: 345 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXXPIYEGYALPHAIXRLDLAGXXXXXXXXXXXXXXXXXXXX

SEQ ID NO: 346 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVXIYEGYALPHAIXRLDLAGXXXXXXXXXXXXXXXXXXXX

SEQ ID NO: 347 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPXYEGYALPHAIXRLDLAGXXXXXXXXXXXXXXXXXXXX

SEQ ID NO: 348 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIXEGYALPHAIXRLDLAGXXXXXXXXXXXXXXXXXXXX

SEQ ID NO: 349 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYXGYALPHAIXRLDLAGXXXXXXXXXXXXXXXXXXXX

SEQ ID NO: 350 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEXYALPHAIXRLDLAGXXXXXXXXXXXXXXXXXXXX

SEQ ID NO: 351 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGXALPHAIXRLDLAGXXXXXXXXXXXXXXXXXXXX

SEQ ID NO: 352 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYXLPHAIXRLDLAGXXXXXXXXXXXXXXXXXXXX

SEQ ID NO: 353 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYAXPHAIXRLDLAGXXXXXXXXXXXXXXXXXXXX

SEQ ID NO: 354 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALXHAIXRLDLAGXXXXXXXXXXXXXXXXXXXX

SEQ ID NO: 355 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPXAIXRLDLAGXXXXXXXXXXXXXXXXXXXX

SEQ ID NO: 356 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHXIXRLDLAGXXXXXXXXXXXXXXXXXXXX

SEQ ID NO: 357 - protein, 60 aa, Artificial Sequence
  synthetic peptide
  MISC_FEATURE (1)..(20): Xaa may be Gly, Ala, or absent.
  MISC_FEATURE (33)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAXXRLDLAGXXXXXXXXXXXXXXXXXXXX

SEQ ID NO: 358 - protein, 60 aa, Artificial Sequence
  synthetic peptide
  MISC_FEATURE (1)..(20): Xaa may be Gly, Ala, or absent.
  MISC_FEATURE (34)..(35): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXXLDLAGXXXXXXXXXXXXXXXXXXXX

SEQ ID NO: 359 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRXDLAGXXXXXXXXXXXXXXXXXXXX

SEQ ID NO: 360 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRLXLAGXXXXXXXXXXXXXXXXXXXX

SEQ ID NO: 361 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRLDXAGXXXXXXXXXXXXXXXXXXXX

SEQ ID NO: 362 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRLDLXGXXXXXXXXXXXXXXXXXXXX

SEQ ID NO: 363 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRLDLAXXXXXXXXXXXXXXXXXXXXX

SEQ ID NO: 364 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXXPHAIXRLDLAGRDLTDYLMXXXXXXXXXXXXXXXXXXXX

SEQ ID NO: 365 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXLXHAIXRLDLAGRDLTDYLMXXXXXXXXXXXXXXXXXXXX

SEQ ID NO: 366 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXLPXAIXRLDLAGRDLTDYLMXXXXXXXXXXXXXXXXXXXX

SEQ ID NO: 367 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXLPHXIXRLDLAGRDLTDYLMXXXXXXXXXXXXXXXXXXXX

SEQ ID NO: 368 - protein, 60 aa, Artificial Sequence
  synthetic peptide
  MISC_FEATURE (1)..(20): Xaa may be Gly, Ala, or absent.
  MISC_FEATURE (25)..(26): Xaa may be any natural amino acid or any unnatural amino acid.
  MISC_FEATURE (41)..(60): Xaa may be Gly, Ala, or absent.
XXXXXXXXXXXXXXXXXXXXLPHAXXRLDLAGRDLTDYLMXXXXXXXXXXXXXXXXXXXX

SEQ ID NO: 369 - protein, 60 aa, Artificial Sequence
  synthetic peptide
  MISC_FEATURE (1)..(20): Xaa may be Gly, Ala, or absent.
  MISC_FEATURE (26)..(27): Xaa may be any natural amino acid or any unnatural amino acid.
  MISC_FEATURE (41)..(60): Xaa may be Gly, Ala, or absent.
XXXXXXXXXXXXXXXXXXXXLPHAIXXLDLAGRDLTDYLMXXXXXXXXXXXXXXXXXXXX

SEQ ID NO: 370 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXLPHAIXRXDLAGRDLTDYLMXXXXXXXXXXXXXXXXXXXX

SEQ ID NO: 371 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLXLAGRDLTDYLMXXXXXXXXXXXXXXXXXXXX

SEQ ID NO: 372 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDXAGRDLTDYLMXXXXXXXXXXXXXXXXXXXX

SEQ ID NO: 373 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLXGRDLTDYLMXXXXXXXXXXXXXXXXXXXX

SEQ ID NO: 374 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAXRDLTDYLMXXXXXXXXXXXXXXXXXXXX

SEQ ID NO: 375 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGXDLTDYLMXXXXXXXXXXXXXXXXXXXX

SEQ ID NO: 376 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRXLTDYLMXXXXXXXXXXXXXXXXXXXX

SEQ ID NO: 377 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDXTDYLMXXXXXXXXXXXXXXXXXXXX

SEQ ID NO: 378 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLXDYLMXXXXXXXXXXXXXXXXXXXX

SEQ ID NO: 379 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLTXYLMXXXXXXXXXXXXXXXXXXXX

SEQ ID NO: 380 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLTDXLMXXXXXXXXXXXXXXXXXXXX

SEQ ID NO: 381 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLTDYXMXXXXXXXXXXXXXXXXXXXX

SEQ ID NO: 382 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLTDYLXXXXXXXXXXXXXXXXXXXXX

SEQ ID NO: 383 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXVXDSGDGVTHXVPIYEGYALXXXXXXXXXXXXXXXXXXXX

SEQ ID NO: 384 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXXDSGDGVTHXVPIYEGYALPXXXXXXXXXXXXXXXXXXXX

SEQ ID NO: 385 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXDSGDGVTHXVPIYEGYALPHXXXXXXXXXXXXXXXXXXXX

SEQ ID NO: 386 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXSGDGVTHXVPIYEGYALPHAXXXXXXXXXXXXXXXXXXXX

SEQ ID NO: 387 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (41)..(60): Xaa may be Gly, Ala, or absent.
XXXXXXXXXXXXXXXXXXXXGDGVTHXVPIYEGYALPHAIXXXXXXXXXXXXXXXXXXXX

SEQ ID NO: 388 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXDGVTHXVPIYEGYALPHAIXXXXXXXXXXXXXXXXXXXXX

SEQ ID NO: 389 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXGVTHXVPIYEGYALPHAIXRXXXXXXXXXXXXXXXXXXXX

SEQ ID NO: 390 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXVTHXVPIYEGYALPHAIXRLXXXXXXXXXXXXXXXXXXXX

SEQ ID NO: 391 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXTHXVPIYEGYALPHAIXRLDXXXXXXXXXXXXXXXXXXXX

SEQ ID NO: 392 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXHXVPIYEGYALPHAIXRLDLXXXXXXXXXXXXXXXXXXXX

SEQ ID NO: 393 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXXVPIYEGYALPHAIXRLDLAXXXXXXXXXXXXXXXXXXXX

SEQ ID NO: 394 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXVPIYEGYALPHAIXRLDLAGXXXXXXXXXXXXXXXXXXXX

SEQ ID NO: 395 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXPIYEGYALPHAIXRLDLAGRXXXXXXXXXXXXXXXXXXXX

SEQ ID NO: 396 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXIYEGYALPHAIXRLDLAGRDXXXXXXXXXXXXXXXXXXXX

SEQ ID NO: 397 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXYEGYALPHAIXRLDLAGRDLXXXXXXXXXXXXXXXXXXXX

SEQ ID NO: 398 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXEGYALPHAIXRLDLAGRDLTXXXXXXXXXXXXXXXXXXXX

SEQ ID NO: 399 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXGYALPHAIXRLDLAGRDLTDXXXXXXXXXXXXXXXXXXXX

SEQ ID NO: 400 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXYALPHAIXRLDLAGRDLTDYXXXXXXXXXXXXXXXXXXXX

SEQ ID NO: 401 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (41)..(60): Xaa may be Gly, Ala, or absent.
XXXXXXXXXXXXXXXXXXXXALPHAIXRLDLAGRDLTDYLXXXXXXXXXXXXXXXXXXXX

SEQ ID NO: 402 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXLPHAIXRLDLAGRDLTDYLMXXXXXXXXXXXXXXXXXXXX

SEQ ID NO: 403 - protein, 60 aa, Artificial Sequence
  synthetic peptide
  MISC_FEATURE (1)..(20): Xaa may be Gly, Ala, or absent.
  MISC_FEATURE (25)..(25): Xaa may be Gly, Ala, or absent.
  MISC_FEATURE (41)..(60): Xaa may be Gly, Ala, or absent.
XXXXXXXXXXXXXXXXXXXXPHAIXRLDLAGRDLTDYLMKXXXXXXXXXXXXXXXXXXXX

SEQ ID NO: 404 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (41)..(60): Xaa may be Gly, Ala, or absent.
XXXXXXXXXXXXXXXXXXXXHAIXRLDLAGRDLTDYLMKIXXXXXXXXXXXXXXXXXXXX

SEQ ID NO: 405 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (41)..(60): Xaa may be Gly, Ala, or absent.
XXXXXXXXXXXXXXXXXXXXAIXRLDLAGRDLTDYLMKILXXXXXXXXXXXXXXXXXXXX

SEQ ID NO: 406 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(60): Xaa may be Gly, Ala, or absent.
XXXXXXXXXXXXXXXXXXXXIXRLDLAGRDLTDYLMKILTXXXXXXXXXXXXXXXXXXXX

SEQ ID NO: 407 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXRLDLAGRDLTDYLMKILTEXXXXXXXXXXXXXXXXXXXX

SEQ ID NO: 408 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXLDLAGRDLTDYLMKILTERXXXXXXXXXXXXXXXXXXXX

SEQ ID NO: 409 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXDLAGRDLTDYLMKILTERGXXXXXXXXXXXXXXXXXXXX

SEQ ID NO: 410 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXLAGRDLTDYLMKILTERGYXXXXXXXXXXXXXXXXXXXX

SEQ ID NO: 411 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXAGRDLTDYLMKILTERGYSXXXXXXXXXXXXXXXXXXXX

SEQ ID NO: 412 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXGRDLTDYLMKILTERGYSFXXXXXXXXXXXXXXXXXXXX

SEQ ID NO: 413 - protein, 60 aa, Artificial Sequence; identical to SEQ ID NO: 364
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.

SEQ ID NO: 414 - protein, 60 aa, Artificial Sequence; identical to SEQ ID NO: 365
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.

SEQ ID NO: 415 - protein, 60 aa, Artificial Sequence; identical to SEQ ID NO: 366
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.

SEQ ID NO: 416 - protein, 60 aa, Artificial Sequence; identical to SEQ ID NO: 367
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (26)..(26): Xaa may be any natural amino acid or any unnatural amino acid.
  MISC_FEATURE (41)..(60): Xaa may be Gly, Ala, or absent.

SEQ ID NO: 417 - protein, 60 aa, Artificial Sequence; identical to SEQ ID NO: 368
  synthetic peptide
  MISC_FEATURE (1)..(20): Xaa may be Gly, Ala, or absent.
  MISC_FEATURE (25)..(26): Xaa may be any natural amino acid or any unnatural amino acid.
  MISC_FEATURE (41)..(60): Xaa may be Gly, Ala, or absent.

SEQ ID NO: 418 - protein, 60 aa, Artificial Sequence; identical to SEQ ID NO: 368
  synthetic peptide
  MISC_FEATURE (1)..(20): Xaa may be Gly, Ala, or absent.
  MISC_FEATURE (25)..(26): Xaa may be any natural amino acid or any unnatural amino acid.
  MISC_FEATURE (41)..(60): Xaa may be Gly, Ala, or absent.

SEQ ID NO: 419 - protein, 60 aa, Artificial Sequence; identical to SEQ ID NO: 369
  synthetic peptide
  MISC_FEATURE (1)..(20): Xaa may be Gly, Ala, or absent.
  MISC_FEATURE (26)..(27): Xaa may be any natural amino acid or any unnatural amino acid.
  MISC_FEATURE (41)..(60): Xaa may be Gly, Ala, or absent.

SEQ ID NO: 420 - protein, 60 aa, Artificial Sequence; identical to SEQ ID NO: 370
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (28)..(28): Xaa may be any natural amino acid or any unnatural amino acid.
  MISC_FEATURE (41)..(60): Xaa may be Gly, Ala, or absent.

SEQ ID NO: 421 - protein, 60 aa, Artificial Sequence; identical to SEQ ID NO: 371
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (29)..(29): Xaa may be any natural amino acid or any unnatural amino acid.
  MISC_FEATURE (41)..(60): Xaa may be Gly, Ala, or absent.

SEQ ID NO: 422 - protein, 60 aa, Artificial Sequence; identical to SEQ ID NO: 372
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (30)..(30): Xaa may be any natural amino acid or any unnatural amino acid.
  MISC_FEATURE (41)..(60): Xaa may be Gly, Ala, or absent.

SEQ ID NO: 423 - protein, 60 aa, Artificial Sequence; identical to SEQ ID NO: 373
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(31): Xaa may be any natural amino acid or any unnatural amino acid.
  MISC_FEATURE (41)..(60): Xaa may be Gly, Ala, or absent.

SEQ ID NO: 424 - protein, 60 aa, Artificial Sequence; identical to SEQ ID NO: 374
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (32)..(32): Xaa may be any natural amino acid or any unnatural amino acid.
  MISC_FEATURE (41)..(60): Xaa may be Gly, Ala, or absent.

SEQ ID NO: 425 - protein, 60 aa, Artificial Sequence; identical to SEQ ID NO: 375
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (33)..(33): Xaa may be any natural amino acid or any unnatural amino acid.
  MISC_FEATURE (41)..(60): Xaa may be Gly, Ala, or absent.

SEQ ID NO: 426 - protein, 60 aa, Artificial Sequence; identical to SEQ ID NO: 376
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (34)..(34): Xaa may be any natural amino acid or any unnatural amino acid.
  MISC_FEATURE (41)..(60): Xaa may be Gly, Ala, or absent.

SEQ ID NO: 427 - protein, 60 aa, Artificial Sequence; identical to SEQ ID NO: 377
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.

SEQ ID NO: 428 - protein, 60 aa, Artificial Sequence; identical to SEQ ID NO: 378
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (36)..(36): Xaa may be any natural amino acid or any unnatural amino acid.
  MISC_FEATURE (41)..(60): Xaa may be Gly, Ala, or absent.

SEQ ID NO: 429 - protein, 60 aa, Artificial Sequence; identical to SEQ ID NO: 379
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (37)..(37): Xaa may be any natural amino acid or any unnatural amino acid.
  MISC_FEATURE (41)..(60): Xaa may be Gly, Ala, or absent.

SEQ ID NO: 430 - protein, 60 aa, Artificial Sequence; identical to SEQ ID NO: 380
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (38)..(38): Xaa may be any natural amino acid or any unnatural amino acid.
  MISC_FEATURE (41)..(60): Xaa may be Gly, Ala, or absent.

SEQ ID NO: 431 - protein, 60 aa, Artificial Sequence; identical to SEQ ID NO: 381
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (39)..(39): Xaa may be any natural amino acid or any unnatural amino acid.
  MISC_FEATURE (41)..(60): Xaa may be Gly, Ala, or absent.

SEQ ID NO: 432 - protein, 60 aa, Artificial Sequence; identical to SEQ ID NO: 382
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (40)..(40): Xaa may be any natural amino acid or any unnatural amino acid.
  MISC_FEATURE (41)..(60): Xaa may be Gly, Ala, or absent.

SEQ ID NO: 433 - protein, 81 aa, Artificial Sequence
  synthetic peptide
  MISC_FEATURE (1)..(20): Xaa may be Gly, Ala, or absent.
  MISC_FEATURE (21)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXXXDSGDGVTHXVPIYEGYALPHAIXRLDLAGRDLTDYLMKIXXXXXXXXXXXXXXXXXXXX

SEQ ID NO: 434 - protein, 81 aa, Artificial Sequence
  synthetic peptide
  MISC_FEATURE (1)..(20): Xaa may be Gly, Ala, or absent.
  MISC_FEATURE (22)..(23): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXXSGDGVTHXVPIYEGYALPHAIXRLDLAGRDLTDYLMKIXXXXXXXXXXXXXXXXXXXX

SEQ ID NO: 435 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (24)..(24): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDXGDGVTHXVPIYEGYALPHAIXRLDLAGRDLTDYLMKIXXXXXXXXXXXXXXXXXXXX

SEQ ID NO: 436 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (25)..(25): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSXDGVTHXVPIYEGYALPHAIXRLDLAGRDLTDYLMKIXXXXXXXXXXXXXXXXXXXX

SEQ ID NO: 437 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (26)..(26): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGXGVTHXVPIYEGYALPHAIXRLDLAGRDLTDYLMKIXXXXXXXXXXXXXXXXXXXX

SEQ ID NO: 438 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (27)..(27): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDXVTHXVPIYEGYALPHAIXRLDLAGRDLTDYLMKIXXXXXXXXXXXXXXXXXXXX

SEQ ID NO: 439 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (28)..(28): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGXTHXVPIYEGYALPHAIXRLDLAGRDLTDYLMKIXXXXXXXXXXXXXXXXXXXX

SEQ ID NO: 440 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (29)..(29): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVXHXVPIYEGYALPHAIXRLDLAGRDLTDYLMKIXXXXXXXXXXXXXXXXXXXX

SEQ ID NO: 441 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (30)..(31): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTXXVPIYEGYALPHAIXRLDLAGRDLTDYLMKIXXXXXXXXXXXXXXXXXXXX

SEQ ID NO: 442 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(32): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXXPIYEGYALPHAIXRLDLAGRDLTDYLMKIXXXXXXXXXXXXXXXXXXXX

SEQ ID NO: 443 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (33)..(33): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVXIYEGYALPHAIXRLDLAGRDLTDYLMKIXXXXXXXXXXXXXXXXXXXX

SEQ ID NO: 444 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (34)..(34): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPXYEGYALPHAIXRLDLAGRDLTDYLMKIXXXXXXXXXXXXXXXXXXXX

SEQ ID NO: 445 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (35)..(35): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIXEGYALPHAIXRLDLAGRDLTDYLMKIXXXXXXXXXXXXXXXXXXXX

SEQ ID NO: 446 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (36)..(36): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYXGYALPHAIXRLDLAGRDLTDYLMKIXXXXXXXXXXXXXXXXXXXX

SEQ ID NO: 447 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (37)..(37): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEXYALPHAIXRLDLAGRDLTDYLMKIXXXXXXXXXXXXXXXXXXXX

SEQ ID NO: 448 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (38)..(38): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGXALPHAIXRLDLAGRDLTDYLMKIXXXXXXXXXXXXXXXXXXXX

SEQ ID NO: 449 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (39)..(39): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYXLPHAIXRLDLAGRDLTDYLMKIXXXXXXXXXXXXXXXXXXXX

SEQ ID NO: 450 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (40)..(40): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYAXPHAIXRLDLAGRDLTDYLMKIXXXXXXXXXXXXXXXXXXXX

SEQ ID NO: 451 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (41)..(41): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALXHAIXRLDLAGRDLTDYLMKIXXXXXXXXXXXXXXXXXXXX

SEQ ID NO: 452 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (42)..(42): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPXAIXRLDLAGRDLTDYLMKIXXXXXXXXXXXXXXXXXXXX

SEQ ID NO: 453 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (43)..(43): Xaa may be any natural amino acid or any unnatural amino acid.
  MISC_FEATURE (45)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHXIXRLDLAGRDLTDYLMKIXXXXXXXXXXXXXXXXXXXX

SEQ ID NO: 454 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (44)..(45): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAXXRLDLAGRDLTDYLMKIXXXXXXXXXXXXXXXXXXXX

SEQ ID NO: 455 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(46): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXXLDLAGRDLTDYLMKIXXXXXXXXXXXXXXXXXXXX

SEQ ID NO: 456 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (47)..(47): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRXDLAGRDLTDYLMKIXXXXXXXXXXXXXXXXXXXX

SEQ ID NO: 457 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (48)..(48): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLXLAGRDLTDYLMKIXXXXXXXXXXXXXXXXXXXX

SEQ ID NO: 458 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (49)..(49): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDXAGRDLTDYLMKIXXXXXXXXXXXXXXXXXXXX

SEQ ID NO: 459 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (50)..(50): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLXGRDLTDYLMKIXXXXXXXXXXXXXXXXXXXX

SEQ ID NO: 460 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (51)..(51): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAXRDLTDYLMKIXXXXXXXXXXXXXXXXXXXX

SEQ ID NO: 461 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (52)..(52): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGXDLTDYLMKIXXXXXXXXXXXXXXXXXXXX

SEQ ID NO: 462 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (53)..(53): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRXLTDYLMKIXXXXXXXXXXXXXXXXXXXX

SEQ ID NO: 463 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (54)..(54): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDXTDYLMKIXXXXXXXXXXXXXXXXXXXX

SEQ ID NO: 464 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (55)..(55): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLXDYLMKIXXXXXXXXXXXXXXXXXXXX

SEQ ID NO: 465 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (56)..(56): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTXYLMKIXXXXXXXXXXXXXXXXXXXX

SEQ ID NO: 466 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (57)..(57): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTDXLMKIXXXXXXXXXXXXXXXXXXXX

SEQ ID NO: 467 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (58)..(58): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTDYXMKIXXXXXXXXXXXXXXXXXXXX

SEQ ID NO: 468 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (59)..(59): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTDYLXKIXXXXXXXXXXXXXXXXXXXX

SEQ ID NO: 469 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (60)..(60): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTDYLMXIXXXXXXXXXXXXXXXXXXXX

SEQ ID NO: 470 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (45)..(45): Xaa may be any natural amino acid or any unnatural amino acid.
  MISC_FEATURE (61)..(61): Xaa may be any natural amino acid or any unnatural amino acid.
  MISC_FEATURE (62)..(81): Xaa may be Gly, Ala, or absent.
XXXXXXXXXXXXXXXXXXXXVXDSGDGVTHXVPIYEGYALPHAIXRLDLAGRDLTDYLMKXXXXXXXXXXXXXXXXXXXXX

SEQ ID NO: 471 - protein, 50 aa, Artificial Sequence; identical to SEQ ID NO: 333
  synthetic peptide
  MISC_FEATURE (1)..(20): Xaa may be any natural amino acid or any unnatural amino acid or absent.
  MISC_FEATURE (31)..(50): Xaa may be any natural amino acid or any unnatural amino acid or absent.

SEQ ID NO: 472 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXGRDLTDYLMXXXXXXXXXXXXXXXXXXXX

SEQ ID NO: 473 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.
XXXXXXXXXXXXXXXXXXXXAXRDLTDYLMXXXXXXXXXXXXXXXXXXXX

SEQ ID NO: 474 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.
XXXXXXXXXXXXXXXXXXXXAGXDLTDYLMXXXXXXXXXXXXXXXXXXXX

SEQ ID NO: 475 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.
XXXXXXXXXXXXXXXXXXXXAGRXLTDYLMXXXXXXXXXXXXXXXXXXXX

SEQ ID NO: 476 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.
XXXXXXXXXXXXXXXXXXXXAGRDXTDYLMXXXXXXXXXXXXXXXXXXXX

SEQ ID NO: 477 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.
XXXXXXXXXXXXXXXXXXXXAGRDLXDYLMXXXXXXXXXXXXXXXXXXXX

SEQ ID NO: 478 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (31)..(50): Xaa may be Gly, Ala, or absent.
XXXXXXXXXXXXXXXXXXXXAGRDLTXYLMXXXXXXXXXXXXXXXXXXXX

SEQ ID NO: 479 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXAGRDLTDXLMXXXXXXXXXXXXXXXXXXXX

SEQ ID NO: 480 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXAGRDLTDYXMXXXXXXXXXXXXXXXXXXXX

SEQ ID NO: 481 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXAGRDLTDYLXXXXXXXXXXXXXXXXXXXXX

SEQ ID NO: 482 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXDYLMKILTEXXXXXXXXXXXXXXXXXXXX

SEQ ID NO: 483 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.
XXXXXXXXXXXXXXXXXXXXTXYLMKILTEXXXXXXXXXXXXXXXXXXXX

SEQ ID NO: 484 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.
XXXXXXXXXXXXXXXXXXXXTDXLMKILTEXXXXXXXXXXXXXXXXXXXX

SEQ ID NO: 485 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.
XXXXXXXXXXXXXXXXXXXXTDYXMKILTEXXXXXXXXXXXXXXXXXXXX

SEQ ID NO: 486 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.
XXXXXXXXXXXXXXXXXXXXTDYLXKILTEXXXXXXXXXXXXXXXXXXXX

SEQ ID NO: 487 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.
XXXXXXXXXXXXXXXXXXXXTDYLMXILTEXXXXXXXXXXXXXXXXXXXX

SEQ ID NO: 488 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (31)..(50): Xaa may be Gly, Ala, or absent.
XXXXXXXXXXXXXXXXXXXXTDYLMKXLTEXXXXXXXXXXXXXXXXXXXX

SEQ ID NO: 489 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXTDYLMKIXTEXXXXXXXXXXXXXXXXXXXX

SEQ ID NO: 490 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXTDYLMKILXEXXXXXXXXXXXXXXXXXXXX

SEQ ID NO: 491 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXTDYLMKILTXXXXXXXXXXXXXXXXXXXXX

SEQ ID NO: 492 - protein, 50 aa, Artificial Sequence; identical to SEQ ID NO: 296
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.

SEQ ID NO: 493 - protein, 50 aa, Artificial Sequence; identical to SEQ ID NO: 325
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.

SEQ ID NO: 494 - protein, 50 aa, Artificial Sequence; identical to SEQ ID NO: 326
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.

SEQ ID NO: 495 - protein, 50 aa, Artificial Sequence; identical to SEQ ID NO: 327
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.

SEQ ID NO: 496 - protein, 50 aa, Artificial Sequence; identical to SEQ ID NO: 328
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.

SEQ ID NO: 497 - protein, 50 aa, Artificial Sequence; identical to SEQ ID NO: 329
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.

SEQ ID NO: 498 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLDLAGRDLTXXXXXXXXXXXXXXXXXXXX

SEQ ID NO: 499 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXDLAGRDLTDXXXXXXXXXXXXXXXXXXXX

SEQ ID NO: 500 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLAGRDLTDYXXXXXXXXXXXXXXXXXXXX

SEQ ID NO: 501 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXAGRDLTDYLXXXXXXXXXXXXXXXXXXXX

SEQ ID NO: 502 - protein, 50 aa, Artificial Sequence; identical to SEQ ID NO: 472
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.

SEQ ID NO: 503 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXRDLTDYLMKXXXXXXXXXXXXXXXXXXXX

SEQ ID NO: 504 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXDLTDYLMKIXXXXXXXXXXXXXXXXXXXX

SEQ ID NO: 505 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLTDYLMKILXXXXXXXXXXXXXXXXXXXX

SEQ ID NO: 506 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXTDYLMKILTXXXXXXXXXXXXXXXXXXXX

SEQ ID NO: 507 - protein, 50 aa, Artificial Sequence; identical to SEQ ID NO: 482
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.

SEQ ID NO: 508 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXYLMKILTERXXXXXXXXXXXXXXXXXXXX

SEQ ID NO: 509 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLMKILTERGXXXXXXXXXXXXXXXXXXXX

SEQ ID NO: 510 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXMKILTERGYXXXXXXXXXXXXXXXXXXXX

SEQ ID NO: 511 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKILTERGYSXXXXXXXXXXXXXXXXXXXX

SEQ ID NO: 512 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXXILTERGYSFXTTAEREIVRXXXXXXXXXXXXXXXXXXXX

SEQ ID NO: 513 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXILTERGYSFXXXXXXXXXXXXXXXXXXXXX

SEQ ID NO: 514 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXLTERGYSFXTXXXXXXXXXXXXXXXXXXXX

SEQ ID NO: 515 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXTERGYSFXTTXXXXXXXXXXXXXXXXXXXX

SEQ ID NO: 516 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (31)..(50): Xaa may be Gly, Ala, or absent.
XXXXXXXXXXXXXXXXXXXXERGYSFXTTAXXXXXXXXXXXXXXXXXXXX

SEQ ID NO: 517 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.
XXXXXXXXXXXXXXXXXXXXRGYSFXTTAEXXXXXXXXXXXXXXXXXXXX

SEQ ID NO: 518 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.
XXXXXXXXXXXXXXXXXXXXGYSFXTTAERXXXXXXXXXXXXXXXXXXXX

SEQ ID NO: 519 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.
XXXXXXXXXXXXXXXXXXXXYSFXTTAEREXXXXXXXXXXXXXXXXXXXX

SEQ ID NO: 520 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.
XXXXXXXXXXXXXXXXXXXXSFXTTAEREIXXXXXXXXXXXXXXXXXXXX

SEQ ID NO: 521 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.
XXXXXXXXXXXXXXXXXXXXFXTTAEREIVXXXXXXXXXXXXXXXXXXXX

SEQ ID NO: 522 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXTTAEREIVRXXXXXXXXXXXXXXXXXXXX

SEQ ID NO: 523 - protein, 60 aa, Artificial Sequence; identical to SEQ ID NO: 412
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.

SEQ ID NO: 524 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(60): Xaa may be Gly, Ala, or absent.
XXXXXXXXXXXXXXXXXXXXAXRDLTDYLMKILTERGYSFXXXXXXXXXXXXXXXXXXXX

SEQ ID NO: 525 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (41)..(60): Xaa may be Gly, Ala, or absent.
XXXXXXXXXXXXXXXXXXXXAGXDLTDYLMKILTERGYSFXXXXXXXXXXXXXXXXXXXX

SEQ ID NO: 526 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (41)..(60): Xaa may be Gly, Ala, or absent.
XXXXXXXXXXXXXXXXXXXXAGRXLTDYLMKILTERGYSFXXXXXXXXXXXXXXXXXXXX

SEQ ID NO: 527 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (41)..(60): Xaa may be Gly, Ala, or absent.
XXXXXXXXXXXXXXXXXXXXAGRDXTDYLMKILTERGYSFXXXXXXXXXXXXXXXXXXXX

SEQ ID NO: 528 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXAGRDLXDYLMKILTERGYSFXXXXXXXXXXXXXXXXXXXX

SEQ ID NO: 529 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (41)..(60): Xaa may be Gly, Ala, or absent.
XXXXXXXXXXXXXXXXXXXXAGRDLTXYLMKILTERGYSFXXXXXXXXXXXXXXXXXXXX

SEQ ID NO: 530 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXAGRDLTDXLMKILTERGYSFXXXXXXXXXXXXXXXXXXXX

SEQ ID NO: 531 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYXMKILTERGYSFXXXXXXXXXXXXXXXXXXXX

SEQ ID NO: 532 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLXKILTERGYSFXXXXXXXXXXXXXXXXXXXX

SEQ ID NO: 533 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMXILTERGYSFXXXXXXXXXXXXXXXXXXXX

SEQ ID NO: 534 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKXLTERGYSFXXXXXXXXXXXXXXXXXXXX

SEQ ID NO: 535 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKIXTERGYSFXXXXXXXXXXXXXXXXXXXX

SEQ ID NO: 536 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILXERGYSFXXXXXXXXXXXXXXXXXXXX

SEQ ID NO: 537 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTXRGYSFXXXXXXXXXXXXXXXXXXXX

SEQ ID NO: 538 - protein, 60 aa, Artificial Sequence
  synthetic peptide
  MISC_FEATURE (1)..(20): Xaa may be Gly, Ala, or absent.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTEXGYSFXXXXXXXXXXXXXXXXXXXX

SEQ ID NO: 539 - protein, 60 aa, Artificial Sequence
  synthetic peptide
  MISC_FEATURE (1)..(20): Xaa may be Gly, Ala, or absent.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTERXYSFXXXXXXXXXXXXXXXXXXXX

SEQ ID NO: 540 - protein, 60 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTERGXSFXXXXXXXXXXXXXXXXXXXX

SEQ ID NO: 541 - protein, 60 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTERGYXFXXXXXXXXXXXXXXXXXXXX

SEQ ID NO: 542 - protein, 60 aa, Artificial Sequence
  synthetic peptide
  MISC_FEATURE (1)..(20): Xaa may be Gly, Ala, or absent.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXAGRDLTDYLMKILTERGYSXXXXXXXXXXXXXXXXXXXXX

SEQ ID NO: 543 - protein, 60 aa, Artificial Sequence; identical to SEQ ID NO: 402
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(60): Xaa may be Gly, Ala, or absent.

SEQ ID NO: 544 - protein, 60 aa, Artificial Sequence; identical to SEQ ID NO: 403
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (41)..(60): Xaa may be Gly, Ala, or absent.

SEQ ID NO: 545 - protein, 60 aa, Artificial Sequence; identical to SEQ ID NO: 404
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (41)..(60): Xaa may be Gly, Ala, or absent.

SEQ ID NO: 546 - protein, 60 aa, Artificial Sequence; identical to SEQ ID NO: 405
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (41)..(60): Xaa may be Gly, Ala, or absent.

SEQ ID NO: 547 - protein, 60 aa, Artificial Sequence; identical to SEQ ID NO: 406
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(60): Xaa may be Gly, Ala, or absent.

SEQ ID NO: 548 - protein, 60 aa, Artificial Sequence; identical to SEQ ID NO: 407
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.

SEQ ID NO: 549 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXRLDLAGRDLTDYLMKILTERXXXXXXXXXXXXXXXXXXXX

SEQ ID NO: 550 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXLDLAGRDLTDYLMKILTERGXXXXXXXXXXXXXXXXXXXX

SEQ ID NO: 551 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXDLAGRDLTDYLMKILTERGYXXXXXXXXXXXXXXXXXXXX

SEQ ID NO: 552 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXLAGRDLTDYLMKILTERGYSXXXXXXXXXXXXXXXXXXXX

SEQ ID NO: 553 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXAGRDLTDYLMKILTERGYSFXXXXXXXXXXXXXXXXXXXX

SEQ ID NO: 554 - protein, 60 aa, Artificial Sequence
  synthetic peptide
  MISC_FEATURE (1)..(20): Xaa may be Gly, Ala, or absent.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXGRDLTDYLMKILTERGYSFXXXXXXXXXXXXXXXXXXXXX

SEQ ID NO: 555 - protein, 60 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXRDLTDYLMKILTERGYSFXTXXXXXXXXXXXXXXXXXXXX

SEQ ID NO: 556 - protein, 60 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXDLTDYLMKILTERGYSFXTTXXXXXXXXXXXXXXXXXXXX

SEQ ID NO: 557 - protein, 60 aa, Artificial Sequence
  synthetic peptide
  MISC_FEATURE (1)..(20): Xaa may be Gly, Ala, or absent.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXLTDYLMKILTERGYSFXTTAXXXXXXXXXXXXXXXXXXXX

SEQ ID NO: 558 - protein, 60 aa, Artificial Sequence
  synthetic peptide
  MISC_FEATURE (1)..(20): Xaa may be Gly, Ala, or absent.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXTDYLMKILTERGYSFXTTAEXXXXXXXXXXXXXXXXXXXX

SEQ ID NO: 559 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDYLMKILTERGYSFXTTAERXXXXXXXXXXXXXXXXXXXX

SEQ ID NO: 560 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXYLMKILTERGYSFXTTAEREXXXXXXXXXXXXXXXXXXXX

SEQ ID NO: 561 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXLMKILTERGYSFXTTAEREIXXXXXXXXXXXXXXXXXXXX

SEQ ID NO: 562 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXMKILTERGYSFXTTAEREIVXXXXXXXXXXXXXXXXXXXX

SEQ ID NO: 563 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXKILTERGYSFXTTAEREIVRXXXXXXXXXXXXXXXXXXXX

SEQ ID NO: 564 - protein, 80 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXXPHAIXRLDLAGRDLTDYLMKILTERGYSFXTTAEREIVRXXXXXXXXXXXXXXXXXXXX

SEQ ID NO: 565 - protein, 80 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLXHAIXRLDLAGRDLTDYLMKILTERGYSFXTTAEREIVRXXXXXXXXXXXXXXXXXXXX

SEQ ID NO: 566 - protein, 80 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPXAIXRLDLAGRDLTDYLMKILTERGYSFXTTAEREIVRXXXXXXXXXXXXXXXXXXXX

SEQ ID NO: 567 - protein, 80 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHXIXRLDLAGRDLTDYLMKILTERGYSFXTTAEREIVRXXXXXXXXXXXXXXXXXXXX

SEQ ID NO: 568 - protein, 80 aa, Artificial Sequence
  synthetic peptide
  MISC_FEATURE (1)..(20): Xaa may be Gly, Ala, or absent.
  MISC_FEATURE (25)..(26): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAXXRLDLAGRDLTDYLMKILTERGYSFXTTAEREIVRXXXXXXXXXXXXXXXXXXXX

SEQ ID NO: 569 - protein, 80 aa, Artificial Sequence
  synthetic peptide
  MISC_FEATURE (1)..(20): Xaa may be Gly, Ala, or absent.
  MISC_FEATURE (26)..(27): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXXLDLAGRDLTDYLMKILTERGYSFXTTAEREIVRXXXXXXXXXXXXXXXXXXXX

SEQ ID NO: 570 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (28)..(28): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRXDLAGRDLTDYLMKILTERGYSFXTTAEREIVRXXXXXXXXXXXXXXXXXXXX

SEQ ID NO: 571 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (29)..(29): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLXLAGRDLTDYLMKILTERGYSFXTTAEREIVRXXXXXXXXXXXXXXXXXXXX

SEQ ID NO: 572 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (30)..(30): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDXAGRDLTDYLMKILTERGYSFXTTAEREIVRXXXXXXXXXXXXXXXXXXXX

SEQ ID NO: 573 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(31): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLXGRDLTDYLMKILTERGYSFXTTAEREIVRXXXXXXXXXXXXXXXXXXXX

SEQ ID NO: 574 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (32)..(32): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAXRDLTDYLMKILTERGYSFXTTAEREIVRXXXXXXXXXXXXXXXXXXXX

SEQ ID NO: 575 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (33)..(33): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGXDLTDYLMKILTERGYSFXTTAEREIVRXXXXXXXXXXXXXXXXXXXX

SEQ ID NO: 576 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (34)..(34): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRXLTDYLMKILTERGYSFXTTAEREIVRXXXXXXXXXXXXXXXXXXXX

SEQ ID NO: 577 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (35)..(35): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDXTDYLMKILTERGYSFXTTAEREIVRXXXXXXXXXXXXXXXXXXXX

SEQ ID NO: 578 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (36)..(36): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLXDYLMKILTERGYSFXTTAEREIVRXXXXXXXXXXXXXXXXXXXX

SEQ ID NO: 579 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (37)..(37): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTXYLMKILTERGYSFXTTAEREIVRXXXXXXXXXXXXXXXXXXXX

SEQ ID NO: 580 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (38)..(38): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDXLMKILTERGYSFXTTAEREIVRXXXXXXXXXXXXXXXXXXXX

SEQ ID NO: 581 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (39)..(39): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYXMKILTERGYSFXTTAEREIVRXXXXXXXXXXXXXXXXXXXX

SEQ ID NO: 582 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (40)..(40): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLXKILTERGYSFXTTAEREIVRXXXXXXXXXXXXXXXXXXXX

SEQ ID NO: 583 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(41): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMXILTERGYSFXTTAEREIVRXXXXXXXXXXXXXXXXXXXX

SEQ ID NO: 584 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (42)..(42): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKXLTERGYSFXTTAEREIVRXXXXXXXXXXXXXXXXXXXX

SEQ ID NO: 585 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (43)..(43): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKIXTERGYSFXTTAEREIVRXXXXXXXXXXXXXXXXXXXX

SEQ ID NO: 586 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (44)..(44): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILXERGYSFXTTAEREIVRXXXXXXXXXXXXXXXXXXXX

SEQ ID NO: 587 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (45)..(45): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTXRGYSFXTTAEREIVRXXXXXXXXXXXXXXXXXXXX

SEQ ID NO: 588 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (46)..(46): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTEXGYSFXTTAEREIVRXXXXXXXXXXXXXXXXXXXX

SEQ ID NO: 589 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (47)..(47): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERXYSFXTTAEREIVRXXXXXXXXXXXXXXXXXXXX

SEQ ID NO: 590 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (48)..(48): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGXSFXTTAEREIVRXXXXXXXXXXXXXXXXXXXX

SEQ ID NO: 591 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (49)..(49): Xaa may be any natural amino acid or any unnatural amino acid.
  MISC_FEATURE (51)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYXFXTTAEREIVRXXXXXXXXXXXXXXXXXXXX

SEQ ID NO: 592 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (50)..(51): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSXXTTAEREIVRXXXXXXXXXXXXXXXXXXXX

SEQ ID NO: 593 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(52): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXXTAEREIVRXXXXXXXXXXXXXXXXXXXX

SEQ ID NO: 594 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (53)..(53): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTXAEREIVRXXXXXXXXXXXXXXXXXXXX

SEQ ID NO: 595 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (54)..(54): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTXEREIVRXXXXXXXXXXXXXXXXXXXX

SEQ ID NO: 596 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (55)..(55): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAXREIVRXXXXXXXXXXXXXXXXXXXX

SEQ ID NO: 597 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (56)..(56): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAEXEIVRXXXXXXXXXXXXXXXXXXXX

SEQ ID NO: 598 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (57)..(57): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAERXIVRXXXXXXXXXXXXXXXXXXXX

SEQ ID NO: 599 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAEREXVRXXXXXXXXXXXXXXXXXXXX

SEQ ID NO: 600 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (59)..(59): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAEREIXRXXXXXXXXXXXXXXXXXXXX

SEQ ID NO: 601 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (51)..(51): Xaa may be any natural amino acid or any unnatural amino acid.
  MISC_FEATURE (60)..(60): Xaa may be any natural amino acid or any unnatural amino acid.
  MISC_FEATURE (61)..(80): Xaa may be Gly, Ala, or absent.
XXXXXXXXXXXXXXXXXXXXLPHAIXRLDLAGRDLTDYLMKILTERGYSFXTTAEREIVXXXXXXXXXXXXXXXXXXXXX

SEQ ID NO: 602 - protein, 50 aa, Artificial Sequence
  synthetic peptide
  MISC_FEATURE (1)..(20): Xaa may be any natural amino acid or any unnatural amino acid or absent.
  MISC_FEATURE (31)..(50): Xaa may be any natural amino acid or any unnatural amino acid or absent.
XXXXXXXXXXXXXXXXXXXXLCYVALDFEQXXXXXXXXXXXXXXXXXXXX

SEQ ID NO: 603 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXXCYVALDFEXXXXXXXXXXXXXXXXXXXXX

SEQ ID NO: 604 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLXYVALDFEXXXXXXXXXXXXXXXXXXXXX

SEQ ID NO: 605 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCXVALDFEXXXXXXXXXXXXXXXXXXXXX

SEQ ID NO: 606 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYXALDFEXXXXXXXXXXXXXXXXXXXXX

SEQ ID NO: 607 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVXLDFEXXXXXXXXXXXXXXXXXXXXX

SEQ ID NO: 608 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVAXDFEXXXXXXXXXXXXXXXXXXXXX

SEQ ID NO: 609 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVALXFEXXXXXXXXXXXXXXXXXXXXX

SEQ ID NO: 610 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVALDXEXXXXXXXXXXXXXXXXXXXXX

SEQ ID NO: 611 - protein, 50 aa, Artificial Sequence
  synthetic peptide
  MISC_FEATURE (1)..(20): Xaa may be Gly, Ala, or absent.
  MISC_FEATURE (29)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVALDFXXXXXXXXXXXXXXXXXXXXXX

SEQ ID NO: 612 - protein, 50 aa, Artificial Sequence; identical to SEQ ID NO: 521
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.

SEQ ID NO: 613 - protein, 50 aa, Artificial Sequence; identical to SEQ ID NO: 522
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.

SEQ ID NO: 614 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXTAEREIVRDXXXXXXXXXXXXXXXXXXXX

SEQ ID NO: 615 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXAEREIVRDIXXXXXXXXXXXXXXXXXXXX

SEQ ID NO: 616 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXEREIVRDIKXXXXXXXXXXXXXXXXXXXX

SEQ ID NO: 617 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXREIVRDIKEXXXXXXXXXXXXXXXXXXXX

SEQ ID NO: 618 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXEIVRDIKEKXXXXXXXXXXXXXXXXXXXX

SEQ ID NO: 619 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIVRDIKEKLXXXXXXXXXXXXXXXXXXXX

SEQ ID NO: 620 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXVRDIKEKLCXXXXXXXXXXXXXXXXXXXX

SEQ ID NO: 621 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXRDIKEKLCYXXXXXXXXXXXXXXXXXXXX

SEQ ID NO: 622 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXDIKEKLCYVXXXXXXXXXXXXXXXXXXXX

SEQ ID NO: 623 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIKEKLCYVAXXXXXXXXXXXXXXXXXXXX

SEQ ID NO: 624 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKEKLCYVALXXXXXXXXXXXXXXXXXXXX

SEQ ID NO: 625 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXEKLCYVALDXXXXXXXXXXXXXXXXXXXX

SEQ ID NO: 626 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKLCYVALDFXXXXXXXXXXXXXXXXXXXX

SEQ ID NO: 627 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLCYVALDFEXXXXXXXXXXXXXXXXXXXX

SEQ ID NO: 628 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLCYVALDFEXXXXXXXXXXXXXXXXXXXXX

SEQ ID NO: 629 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXCYVALDFEXEXXXXXXXXXXXXXXXXXXXX

SEQ ID NO: 630 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXYVALDFEXEMXXXXXXXXXXXXXXXXXXXX

SEQ ID NO: 631 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (31)..(50): Xaa may be Gly, Ala, or absent.
XXXXXXXXXXXXXXXXXXXXVALDFEXEMAXXXXXXXXXXXXXXXXXXXX

SEQ ID NO: 632 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.
XXXXXXXXXXXXXXXXXXXXALDFEXEMATXXXXXXXXXXXXXXXXXXXX

SEQ ID NO: 633 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.
XXXXXXXXXXXXXXXXXXXXLDFEXEMATAXXXXXXXXXXXXXXXXXXXX

SEQ ID NO: 634 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.
XXXXXXXXXXXXXXXXXXXXDFEXEMATAAXXXXXXXXXXXXXXXXXXXX

SEQ ID NO: 635 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.
XXXXXXXXXXXXXXXXXXXXFEXEMATAASXXXXXXXXXXXXXXXXXXXX

SEQ ID NO: 636 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.
XXXXXXXXXXXXXXXXXXXXEXEMATAASSXXXXXXXXXXXXXXXXXXXX

SEQ ID NO: 637 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXEMATAASSSXXXXXXXXXXXXXXXXXXXX

SEQ ID NO: 638 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXMATAASSSSXXXXXXXXXXXXXXXXXXXX

SEQ ID NO: 639 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXATAASSSSLXXXXXXXXXXXXXXXXXXXX

SEQ ID NO: 640 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXTAASSSSLEXXXXXXXXXXXXXXXXXXXX

SEQ ID NO: 641 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXAASSSSLEKXXXXXXXXXXXXXXXXXXXX

SEQ ID NO: 642 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXASSSSLEKSXXXXXXXXXXXXXXXXXXXX

SEQ ID NO: 643 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXSSSSLEKSYXXXXXXXXXXXXXXXXXXXX

SEQ ID NO: 644 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(60): Xaa may be Gly, Ala, or absent.
XXXXXXXXXXXXXXXXXXXXFXTTAEREIVRDIKEKLCYVXXXXXXXXXXXXXXXXXXXX

SEQ ID NO: 645 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXTTAEREIVRDIKEKLCYVAXXXXXXXXXXXXXXXXXXXX

SEQ ID NO: 646 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXTAEREIVRDIKEKLCYVALXXXXXXXXXXXXXXXXXXXX

SEQ ID NO: 647 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXAEREIVRDIKEKLCYVALDXXXXXXXXXXXXXXXXXXXX

SEQ ID NO: 648 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXEREIVRDIKEKLCYVALDFXXXXXXXXXXXXXXXXXXXX

SEQ ID NO: 649 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXREIVRDIKEKLCYVALDFEXXXXXXXXXXXXXXXXXXXX

SEQ ID NO: 650 - protein, 59 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (40)..(59): Xaa may be Gly, Ala, or absent.
XXXXXXXXXXXXXXXXXXXXEIVRDIKEKLCYVALDFEXXXXXXXXXXXXXXXXXXXXX

SEQ ID NO: 651 - protein, 60 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXIVRDIKEKLCYVALDFEXEMXXXXXXXXXXXXXXXXXXXX

SEQ ID NO: 652 - protein, 60 aa, Artificial Sequence
  synthetic peptide
  MISC_FEATURE (1)..(20): Xaa may be Gly, Ala, or absent.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXVRDIKEKLCYVALDFEXEMAXXXXXXXXXXXXXXXXXXXX

SEQ ID NO: 653 - protein, 60 aa, Artificial Sequence
  synthetic peptide
  MISC_FEATURE (1)..(20): Xaa may be Gly, Ala, or absent.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXRDIKEKLCYVALDFEXEMATXXXXXXXXXXXXXXXXXXXX

SEQ ID NO: 654 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXEMATAXXXXXXXXXXXXXXXXXXXX

SEQ ID NO: 655 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXIKEKLCYVALDFEXEMATAAXXXXXXXXXXXXXXXXXXXX

SEQ ID NO: 656 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXKEKLCYVALDFEXEMATAASXXXXXXXXXXXXXXXXXXXX

SEQ ID NO: 657 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXEKLCYVALDFEXEMATAASSXXXXXXXXXXXXXXXXXXXX

SEQ ID NO: 658 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXKLCYVALDFEXEMATAASSSXXXXXXXXXXXXXXXXXXXX

SEQ ID NO: 659 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXLCYVALDFEXEMATAASSSSXXXXXXXXXXXXXXXXXXXX

SEQ ID NO: 660 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXCYVALDFEXEMATAASSSSLXXXXXXXXXXXXXXXXXXXX

SEQ ID NO: 661 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXYVALDFEXEMATAASSSSLEXXXXXXXXXXXXXXXXXXXX

SEQ ID NO: 662 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (41)..(60): Xaa may be Gly, Ala, or absent.
XXXXXXXXXXXXXXXXXXXXVALDFEXEMATAASSSSLEKXXXXXXXXXXXXXXXXXXXX

SEQ ID NO: 663 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXALDFEXEMATAASSSSLEKSXXXXXXXXXXXXXXXXXXXX

SEQ ID NO: 664 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (41)..(60): Xaa may be Gly, Ala, or absent.
XXXXXXXXXXXXXXXXXXXXLDFEXEMATAASSSSLEKSYXXXXXXXXXXXXXXXXXXXX

SEQ ID NO: 665 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (41)..(60): Xaa may be Gly, Ala, or absent.
XXXXXXXXXXXXXXXXXXXXDFEXEMATAASSSSLEKSYEXXXXXXXXXXXXXXXXXXXX

SEQ ID NO: 666 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXXIKEKLCYVALDFEXEMATAXXXXXXXXXXXXXXXXXXXX

SEQ ID NO: 667 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDXKEKLCYVALDFEXEMATAXXXXXXXXXXXXXXXXXXXX

SEQ ID NO: 668 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIXEKLCYVALDFEXEMATAXXXXXXXXXXXXXXXXXXXX

SEQ ID NO: 669 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKXKLCYVALDFEXEMATAXXXXXXXXXXXXXXXXXXXX

SEQ ID NO: 670 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEXLCYVALDFEXEMATAXXXXXXXXXXXXXXXXXXXX

SEQ ID NO: 671 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKXCYVALDFEXEMATAXXXXXXXXXXXXXXXXXXXX

SEQ ID NO: 672 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLXYVALDFEXEMATAXXXXXXXXXXXXXXXXXXXX

SEQ ID NO: 673 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCXVALDFEXEMATAXXXXXXXXXXXXXXXXXXXX

SEQ ID NO: 674 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYXALDFEXEMATAXXXXXXXXXXXXXXXXXXXX

SEQ ID NO: 675 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVXLDFEXEMATAXXXXXXXXXXXXXXXXXXXX

SEQ ID NO: 676 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVAXDFEXEMATAXXXXXXXXXXXXXXXXXXXX

SEQ ID NO: 677 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALXFEXEMATAXXXXXXXXXXXXXXXXXXXX

SEQ ID NO: 678 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDXEXEMATAXXXXXXXXXXXXXXXXXXXX

SEQ ID NO: 679 - protein, 60 aa, Artificial Sequence
  synthetic peptide
  MISC_FEATURE (1)..(20): Xaa may be Gly, Ala, or absent.
  MISC_FEATURE (34)..(35): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFXXEMATAXXXXXXXXXXXXXXXXXXXX

SEQ ID NO: 680 - protein, 60 aa, Artificial Sequence
  synthetic peptide
  MISC_FEATURE (1)..(20): Xaa may be Gly, Ala, or absent.
  MISC_FEATURE (35)..(36): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXXMATAXXXXXXXXXXXXXXXXXXXX

SEQ ID NO: 681 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXEXATAXXXXXXXXXXXXXXXXXXXX

SEQ ID NO: 682 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXEMXTAXXXXXXXXXXXXXXXXXXXX

SEQ ID NO: 683 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXEMAXAXXXXXXXXXXXXXXXXXXXX

SEQ ID NO: 684 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXDIKEKLCYVALDFEXEMATXXXXXXXXXXXXXXXXXXXXX

SEQ ID NO: 685 - protein, 81 aa, Artificial Sequence
  synthetic peptide
  MISC_FEATURE (1)..(20): Xaa may be Gly, Ala, or absent.
  MISC_FEATURE (21)..(22): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXXXTTAEREIVRDIKEKLCYVALDFEXEMATAASSSSLEKSYXXXXXXXXXXXXXXXXXXXX

SEQ ID NO: 686 - protein, 63 aa, Artificial Sequence
  synthetic peptide
  MISC_FEATURE (1)..(2): Xaa may be Gly, Ala, or absent.
  MISC_FEATURE (4)..(5): Xaa may be any natural amino acid or any unnatural amino acid.
  MISC_FEATURE (28)..(28): Xaa may be any natural amino acid or any unnatural amino acid.
  MISC_FEATURE (44)..(63): Xaa may be Gly, Ala, or absent.
XXFXXTAEREIVRDIKEKLCYVALDFEXEMATAASSSSLEKSYXXXXXXXXXXXXXXXXXXXX

SEQ ID NO: 687 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (24)..(24): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTXAEREIVRDIKEKLCYVALDFEXEMATAASSSSLEKSYXXXXXXXXXXXXXXXXXXXX

SEQ ID NO: 688 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (25)..(25): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTXEREIVRDIKEKLCYVALDFEXEMATAASSSSLEKSYXXXXXXXXXXXXXXXXXXXX

SEQ ID NO: 689 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (26)..(26): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAXREIVRDIKEKLCYVALDFEXEMATAASSSSLEKSYXXXXXXXXXXXXXXXXXXXX

SEQ ID NO: 690 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (27)..(27): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEXEIVRDIKEKLCYVALDFEXEMATAASSSSLEKSYXXXXXXXXXXXXXXXXXXXX

SEQ ID NO: 691 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (28)..(28): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAERXIVRDIKEKLCYVALDFEXEMATAASSSSLEKSYXXXXXXXXXXXXXXXXXXXX

SEQ ID NO: 692 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (29)..(29): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREXVRDIKEKLCYVALDFEXEMATAASSSSLEKSYXXXXXXXXXXXXXXXXXXXX

SEQ ID NO: 693 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (30)..(30): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIXRDIKEKLCYVALDFEXEMATAASSSSLEKSYXXXXXXXXXXXXXXXXXXXX

SEQ ID NO: 694 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(31): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVXDIKEKLCYVALDFEXEMATAASSSSLEKSYXXXXXXXXXXXXXXXXXXXX

SEQ ID NO: 695 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (32)..(32): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRXIKEKLCYVALDFEXEMATAASSSSLEKSYXXXXXXXXXXXXXXXXXXXX

SEQ ID NO: 696 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (33)..(33): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDXKEKLCYVALDFEXEMATAASSSSLEKSYXXXXXXXXXXXXXXXXXXXX

SEQ ID NO: 697 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (34)..(34): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIXEKLCYVALDFEXEMATAASSSSLEKSYXXXXXXXXXXXXXXXXXXXX

SEQ ID NO: 698 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (35)..(35): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKXKLCYVALDFEXEMATAASSSSLEKSYXXXXXXXXXXXXXXXXXXXX

SEQ ID NO: 699 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (36)..(36): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEXLCYVALDFEXEMATAASSSSLEKSYXXXXXXXXXXXXXXXXXXXX

SEQ ID NO: 700 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (37)..(37): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKXCYVALDFEXEMATAASSSSLEKSYXXXXXXXXXXXXXXXXXXXX

SEQ ID NO: 701 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (38)..(38): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLXYVALDFEXEMATAASSSSLEKSYXXXXXXXXXXXXXXXXXXXX

SEQ ID NO: 702 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (39)..(39): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCXVALDFEXEMATAASSSSLEKSYXXXXXXXXXXXXXXXXXXXX

SEQ ID NO: 703 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (40)..(40): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYXALDFEXEMATAASSSSLEKSYXXXXXXXXXXXXXXXXXXXX

SEQ ID NO: 704 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(41): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVXLDFEXEMATAASSSSLEKSYXXXXXXXXXXXXXXXXXXXX

SEQ ID NO: 705 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (42)..(42): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVAXDFEXEMATAASSSSLEKSYXXXXXXXXXXXXXXXXXXXX

SEQ ID NO: 706 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (43)..(43): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALXFEXEMATAASSSSLEKSYXXXXXXXXXXXXXXXXXXXX

SEQ ID NO: 707 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (44)..(44): Xaa may be any natural amino acid or any unnatural amino acid.
  MISC_FEATURE (46)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDXEXEMATAASSSSLEKSYXXXXXXXXXXXXXXXXXXXX

SEQ ID NO: 708 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (45)..(46): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFXXEMATAASSSSLEKSYXXXXXXXXXXXXXXXXXXXX

SEQ ID NO: 709 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(47): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXXMATAASSSSLEKSYXXXXXXXXXXXXXXXXXXXX

SEQ ID NO: 710 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (48)..(48): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEXATAASSSSLEKSYXXXXXXXXXXXXXXXXXXXX

SEQ ID NO: 711 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (49)..(49): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMXTAASSSSLEKSYXXXXXXXXXXXXXXXXXXXX

SEQ ID NO: 712 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (50)..(50): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMAXAASSSSLEKSYXXXXXXXXXXXXXXXXXXXX

SEQ ID NO: 713 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (51)..(51): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATXASSSSLEKSYXXXXXXXXXXXXXXXXXXXX

SEQ ID NO: 714 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (52)..(52): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAXSSSSLEKSYXXXXXXXXXXXXXXXXXXXX

SEQ ID NO: 715 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (53)..(53): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATASXSSSLEKSYXXXXXXXXXXXXXXXXXXXX

SEQ ID NO: 716 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (54)..(54): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATASSXSSLEKSYXXXXXXXXXXXXXXXXXXXX

SEQ ID NO: 717 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (55)..(55): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATASSSXSLEKSYXXXXXXXXXXXXXXXXXXXX

SEQ ID NO: 718 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (56)..(56): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATASSSSXLEKSYXXXXXXXXXXXXXXXXXXXX

SEQ ID NO: 719 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (57)..(57): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAASSSSXEKSYXXXXXXXXXXXXXXXXXXXX

SEQ ID NO: 720 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (58)..(58): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAASSSSLXKSYXXXXXXXXXXXXXXXXXXXX

SEQ ID NO: 721 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (59)..(59): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAASSSSLEXSYXXXXXXXXXXXXXXXXXXXX

SEQ ID NO: 722 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (60)..(60): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAASSSSLEKXYXXXXXXXXXXXXXXXXXXXX

SEQ ID NO: 723 - protein, 81 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (46)..(46): Xaa may be any natural amino acid or any unnatural amino acid.
  MISC_FEATURE (61)..(61): Xaa may be any natural amino acid or any unnatural amino acid.
  MISC_FEATURE (62)..(81): Xaa may be Gly, Ala, or absent.
XXXXXXXXXXXXXXXXXXXXFXTTAEREIVRDIKEKLCYVALDFEXEMATAASSSSLEKSXXXXXXXXXXXXXXXXXXXXX

SEQ ID NO: 724 - protein, 50 aa, Artificial Sequence
  synthetic peptide
  MISC_FEATURE (1)..(20): Xaa may be any natural amino acid or any unnatural amino acid or absent.
  MISC_FEATURE (31)..(50): Xaa may be any natural amino acid or any unnatural amino acid or absent.
XXXXXXXXXXXXXXXXXXXXKYSVWIGGSIXXXXXXXXXXXXXXXXXXXX

SEQ ID NO: 725 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXYSVWIGGSIXXXXXXXXXXXXXXXXXXXX

SEQ ID NO: 726 - protein, 50 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (31)..(50): Xaa may be Gly, Ala, or absent.
XXXXXXXXXXXXXXXXXXXXKXSVWIGGSIXXXXXXXXXXXXXXXXXXXX

SEQ ID NO: 727 - protein, 50 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (31)..(50): Xaa may be Gly, Ala, or absent.
XXXXXXXXXXXXXXXXXXXXKYXVWIGGSIXXXXXXXXXXXXXXXXXXXX

SEQ ID NO: 728 - protein, 50 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (31)..(50): Xaa may be Gly, Ala, or absent.
XXXXXXXXXXXXXXXXXXXXKYSXWIGGSIXXXXXXXXXXXXXXXXXXXX

SEQ ID NO: 729 - protein, 50 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (31)..(50): Xaa may be Gly, Ala, or absent.
XXXXXXXXXXXXXXXXXXXXKYSVXIGGSIXXXXXXXXXXXXXXXXXXXX

SEQ ID NO: 730 - protein, 50 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (31)..(50): Xaa may be Gly, Ala, or absent.
XXXXXXXXXXXXXXXXXXXXKYSVWXGGSIXXXXXXXXXXXXXXXXXXXX

SEQ ID NO: 731 - protein, 50 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (31)..(50): Xaa may be Gly, Ala, or absent.
XXXXXXXXXXXXXXXXXXXXKYSVWIXGSIXXXXXXXXXXXXXXXXXXXX

SEQ ID NO: 732 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXKYSVWIGXSIXXXXXXXXXXXXXXXXXXXX

SEQ ID NO: 733 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXKYSVWIGGXIXXXXXXXXXXXXXXXXXXXX

SEQ ID NO: 734 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXKYSVWIGGSXXXXXXXXXXXXXXXXXXXXX

SEQ ID NO: 735 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXPSTMKIKIIXXXXXXXXXXXXXXXXXXXX

SEQ ID NO: 736 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXSTMKIKIIAXXXXXXXXXXXXXXXXXXXX

SEQ ID NO: 737 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXTMKIKIIAPXXXXXXXXXXXXXXXXXXXX

SEQ ID NO: 738 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXMKIKIIAPPXXXXXXXXXXXXXXXXXXXX

SEQ ID NO: 739 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKIKIIAPPEXXXXXXXXXXXXXXXXXXXX

SEQ ID NO: 740 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIKIIAPPERXXXXXXXXXXXXXXXXXXXX

SEQ ID NO: 741 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKIIAPPERKXXXXXXXXXXXXXXXXXXXX

SEQ ID NO: 742 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIIAPPERKYXXXXXXXXXXXXXXXXXXXX

SEQ ID NO: 743 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIAPPERKYSXXXXXXXXXXXXXXXXXXXX

SEQ ID NO: 744 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXAPPERKYSVXXXXXXXXXXXXXXXXXXXX

SEQ ID NO: 745 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXPPERKYSVWXXXXXXXXXXXXXXXXXXXX

SEQ ID NO: 746 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXPERKYSVWIXXXXXXXXXXXXXXXXXXXX

SEQ ID NO: 747 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXERKYSVWIGXXXXXXXXXXXXXXXXXXXX

SEQ ID NO: 748 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXRKYSVWIGGXXXXXXXXXXXXXXXXXXXX

SEQ ID NO: 749 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXKYSVWIGGSXXXXXXXXXXXXXXXXXXXX

SEQ ID NO: 750 - protein, 50 aa, Artificial Sequence; identical to SEQ ID NO: 725
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.

SEQ ID NO: 751 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXSVWIGGSILXXXXXXXXXXXXXXXXXXXX

SEQ ID NO: 752 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXVWIGGSILAXXXXXXXXXXXXXXXXXXXX

SEQ ID NO: 753 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXWIGGSILASXXXXXXXXXXXXXXXXXXXX

SEQ ID NO: 754 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXIGGSILASLXXXXXXXXXXXXXXXXXXXX

SEQ ID NO: 755 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXGGSILASLSXXXXXXXXXXXXXXXXXXXX

SEQ ID NO: 756 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXGSILASLSTXXXXXXXXXXXXXXXXXXXX

SEQ ID NO: 757 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXSILASLSTFXXXXXXXXXXXXXXXXXXXX

SEQ ID NO: 758 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXILASLSTFQXXXXXXXXXXXXXXXXXXXX

SEQ ID NO: 759 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLASLSTFQQXXXXXXXXXXXXXXXXXXXX

SEQ ID NO: 760 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXASLSTFQQMXXXXXXXXXXXXXXXXXXXX

SEQ ID NO: 761 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXSLSTFQQMWXXXXXXXXXXXXXXXXXXXX

SEQ ID NO: 762 - protein, 50 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (31)..(50): Xaa may be Gly, Ala, or absent.
XXXXXXXXXXXXXXXXXXXXXLSTFQQMWIXXXXXXXXXXXXXXXXXXXX

SEQ ID NO: 763 - protein, 50 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (31)..(50): Xaa may be Gly, Ala, or absent.
XXXXXXXXXXXXXXXXXXXXLSTFQQMWIXXXXXXXXXXXXXXXXXXXXX

SEQ ID NO: 764 - protein, 50 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (31)..(50): Xaa may be Gly, Ala, or absent.
XXXXXXXXXXXXXXXXXXXXSTFQQMWIXKXXXXXXXXXXXXXXXXXXXX

SEQ ID NO: 765 - protein, 50 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (31)..(50): Xaa may be Gly, Ala, or absent.
XXXXXXXXXXXXXXXXXXXXTFQQMWIXKQXXXXXXXXXXXXXXXXXXXX

SEQ ID NO: 766 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXAPSTMKIKIIAPPERKYSVWXXXXXXXXXXXXXXXXXXXX

SEQ ID NO: 767 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXPSTMKIKIIAPPERKYSVWIXXXXXXXXXXXXXXXXXXXX

SEQ ID NO: 768 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXSTMKIKIIAPPERKYSVWIGXXXXXXXXXXXXXXXXXXXX

SEQ ID NO: 769 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXTMKIKIIAPPERKYSVWIGGXXXXXXXXXXXXXXXXXXXX

SEQ ID NO: 770 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXMKIKIIAPPERKYSVWIGGSXXXXXXXXXXXXXXXXXXXX

SEQ ID NO: 771 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXKIKIIAPPERKYSVWIGGSIXXXXXXXXXXXXXXXXXXXX

SEQ ID NO: 772 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXIKIIAPPERKYSVWIGGSILXXXXXXXXXXXXXXXXXXXX

SEQ ID NO: 773 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXKIIAPPERKYSVWIGGSILAXXXXXXXXXXXXXXXXXXXX

SEQ ID NO: 774 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXIIAPPERKYSVWIGGSILASXXXXXXXXXXXXXXXXXXXX

SEQ ID NO: 775 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXIAPPERKYSVWIGGSILASLXXXXXXXXXXXXXXXXXXXX

SEQ ID NO: 776 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXAPPERKYSVWIGGSILASLSXXXXXXXXXXXXXXXXXXXX

SEQ ID NO: 777 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXPPERKYSVWIGGSILASLSTXXXXXXXXXXXXXXXXXXXX

SEQ ID NO: 778 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXPERKYSVWIGGSILASLSTFXXXXXXXXXXXXXXXXXXXX

SEQ ID NO: 779 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXERKYSVWIGGSILASLSTFQXXXXXXXXXXXXXXXXXXXX

SEQ ID NO: 780 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXRKYSVWIGGSILASLSTFQQXXXXXXXXXXXXXXXXXXXX

SEQ ID NO: 781 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXKYSVWIGGSILASLSTFQQMXXXXXXXXXXXXXXXXXXXX

SEQ ID NO: 782 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXYSVWIGGSILASLSTFQQMWXXXXXXXXXXXXXXXXXXXX

SEQ ID NO: 783 - protein, 60 aa, Artificial Sequence
  synthetic peptide
  MISC_FEATURE (1)..(20): Xaa may be Gly, Ala, or absent.
  MISC_FEATURE (41)..(60): Xaa may be Gly, Ala, or absent.
XXXXXXXXXXXXXXXXXXXXSVWIGGSILASLSTFQQMWIXXXXXXXXXXXXXXXXXXXX

SEQ ID NO: 784 - protein, 60 aa, Artificial Sequence
  synthetic peptide
  MISC_FEATURE (1)..(20): Xaa may be Gly, Ala, or absent.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXVWIGGSILASLSTFQQMWIXXXXXXXXXXXXXXXXXXXXX

SEQ ID NO: 785 - protein, 60 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXWIGGSILASLSTFQQMWIXKXXXXXXXXXXXXXXXXXXXX

SEQ ID NO: 786 - protein, 60 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXIGGSILASLSTFQQMWIXKQXXXXXXXXXXXXXXXXXXXX

SEQ ID NO: 787 - protein, 60 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (41)..(60): Xaa may be Gly, Ala, or absent.
XXXXXXXXXXXXXXXXXXXXXPPERKYSVWIGGSILASLSXXXXXXXXXXXXXXXXXXXX

SEQ ID NO: 788 - protein, 60 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (41)..(60): Xaa may be Gly, Ala, or absent.
XXXXXXXXXXXXXXXXXXXXAXPERKYSVWIGGSILASLSXXXXXXXXXXXXXXXXXXXX

SEQ ID NO: 789 - protein, 60 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (41)..(60): Xaa may be Gly, Ala, or absent.
XXXXXXXXXXXXXXXXXXXXAPXERKYSVWIGGSILASLSXXXXXXXXXXXXXXXXXXXX

SEQ ID NO: 790 - protein, 60 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (41)..(60): Xaa may be Gly, Ala, or absent.
XXXXXXXXXXXXXXXXXXXXAPPXRKYSVWIGGSILASLSXXXXXXXXXXXXXXXXXXXX

SEQ ID NO: 791 - protein, 60 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (41)..(60): Xaa may be Gly, Ala, or absent.
XXXXXXXXXXXXXXXXXXXXAPPEXKYSVWIGGSILASLSXXXXXXXXXXXXXXXXXXXX

SEQ ID NO: 792 - protein, 60 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (41)..(60): Xaa may be Gly, Ala, or absent.
XXXXXXXXXXXXXXXXXXXXAPPERXYSVWIGGSILASLSXXXXXXXXXXXXXXXXXXXX

SEQ ID NO: 793 - protein, 60 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (41)..(60): Xaa may be Gly, Ala, or absent.
XXXXXXXXXXXXXXXXXXXXAPPERKXSVWIGGSILASLSXXXXXXXXXXXXXXXXXXXX

SEQ ID NO: 794 - protein, 60 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (41)..(60): Xaa may be Gly, Ala, or absent.
XXXXXXXXXXXXXXXXXXXXAPPERKYXVWIGGSILASLSXXXXXXXXXXXXXXXXXXXX

SEQ ID NO: 795 - protein, 60 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (41)..(60): Xaa may be Gly, Ala, or absent.
XXXXXXXXXXXXXXXXXXXXAPPERKYSXWIGGSILASLSXXXXXXXXXXXXXXXXXXXX

SEQ ID NO: 796 - protein, 60 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVXIGGSILASLSXXXXXXXXXXXXXXXXXXXX

SEQ ID NO: 797 - protein, 60 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWXGGSILASLSXXXXXXXXXXXXXXXXXXXX

SEQ ID NO: 798 - protein, 60 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIXGSILASLSXXXXXXXXXXXXXXXXXXXX

SEQ ID NO: 799 - protein, 60 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGXSILASLSXXXXXXXXXXXXXXXXXXXX

SEQ ID NO: 800 - protein, 60 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGXILASLSXXXXXXXXXXXXXXXXXXXX

SEQ ID NO: 801 - protein, 60 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSXLASLSXXXXXXXXXXXXXXXXXXXX

SEQ ID NO: 802 - protein, 60 aa, Artificial Sequence
  synthetic peptide
  MISC_FEATURE (1)..(20): Xaa may be Gly, Ala, or absent.
  MISC_FEATURE (36)..(36): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSIXASLSXXXXXXXXXXXXXXXXXXXX

SEQ ID NO: 803 - protein, 60 aa, Artificial Sequence
  synthetic peptide
  MISC_FEATURE (1)..(20): Xaa may be Gly, Ala, or absent.
  MISC_FEATURE (37)..(37): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSILXSLSXXXXXXXXXXXXXXXXXXXX

SEQ ID NO: 804 - protein, 60 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSILAXLSXXXXXXXXXXXXXXXXXXXX

SEQ ID NO: 805 - protein, 60 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSILASXSXXXXXXXXXXXXXXXXXXXX

SEQ ID NO: 806 - protein, 60 aa, Artificial Sequence
  synthetic peptide
  MISC_FEATURE (1)..(20): Xaa may be Gly, Ala, or absent.
  MISC_FEATURE (40)..(40): Xaa may be any natural amino acid or any unnatural amino acid.
  MISC_FEATURE (41)..(60): Xaa may be Gly, Ala, or absent.
XXXXXXXXXXXXXXXXXXXXAPPERKYSVWIGGSILASLXXXXXXXXXXXXXXXXXXXXX

SEQ ID NO: 807 - protein, 80 aa, Artificial Sequence
  synthetic peptide
  MISC_FEATURE (1)..(20): Xaa may be Gly, Ala, or absent.
  MISC_FEATURE (21)..(21): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXXPSTMKIKIIAPPERKYSVWIGGSILASLSTFQQMWIXKQXXXXXXXXXXXXXXXXXXXX

SEQ ID NO: 808 - protein, 80 aa, Artificial Sequence
  synthetic peptide
  MISC_FEATURE (1)..(20): Xaa may be Gly, Ala, or absent.
  MISC_FEATURE (22)..(22): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAXSTMKIKIIAPPERKYSVWIGGSILASLSTFQQMWIXKQXXXXXXXXXXXXXXXXXXXX

SEQ ID NO: 809 - protein, 80 aa, Artificial Sequence
  synthetic peptide
  MISC_FEATURE (1)..(20): Xaa may be Gly, Ala, or absent.
  MISC_FEATURE (23)..(23): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPXTMKIKIIAPPERKYSVWIGGSILASLSTFQQMWIXKQXXXXXXXXXXXXXXXXXXXX

SEQ ID NO: 810 - protein, 80 aa, Artificial Sequence
  synthetic peptide
  MISC_FEATURE (1)..(20): Xaa may be Gly, Ala, or absent.
  MISC_FEATURE (24)..(24): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSXMKIKIIAPPERKYSVWIGGSILASLSTFQQMWIXKQXXXXXXXXXXXXXXXXXXXX

SEQ ID NO: 811 - protein, 80 aa, Artificial Sequence
  synthetic peptide
  MISC_FEATURE (1)..(20): Xaa may be Gly, Ala, or absent.
  MISC_FEATURE (25)..(25): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTXKIKIIAPPERKYSVWIGGSILASLSTFQQMWIXKQXXXXXXXXXXXXXXXXXXXX

SEQ ID NO: 812 - protein, 80 aa, Artificial Sequence
  synthetic peptide
  MISC_FEATURE (1)..(20): Xaa may be Gly, Ala, or absent.
  MISC_FEATURE (26)..(26): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMXIKIIAPPERKYSVWIGGSILASLSTFQQMWIXKQXXXXXXXXXXXXXXXXXXXX

SEQ ID NO: 813 - protein, 80 aa, Artificial Sequence
  synthetic peptide
  MISC_FEATURE (1)..(20): Xaa may be Gly, Ala, or absent.
  MISC_FEATURE (27)..(27): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKXKIIAPPERKYSVWIGGSILASLSTFQQMWIXKQXXXXXXXXXXXXXXXXXXXX

SEQ ID NO: 814 - protein, 80 aa, Artificial Sequence
  synthetic peptide
  MISC_FEATURE (1)..(20): Xaa may be Gly, Ala, or absent.
  MISC_FEATURE (28)..(28): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIXIIAPPERKYSVWIGGSILASLSTFQQMWIXKQXXXXXXXXXXXXXXXXXXXX

SEQ ID NO: 815 - protein, 80 aa, Artificial Sequence
  synthetic peptide
  MISC_FEATURE (1)..(20): Xaa may be Gly, Ala, or absent.
  MISC_FEATURE (29)..(29): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKXIAPPERKYSVWIGGSILASLSTFQQMWIXKQXXXXXXXXXXXXXXXXXXXX

SEQ ID NO: 816 - protein, 80 aa, Artificial Sequence
  synthetic peptide
  MISC_FEATURE (1)..(20): Xaa may be Gly, Ala, or absent.
  MISC_FEATURE (30)..(30): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIXAPPERKYSVWIGGSILASLSTFQQMWIXKQXXXXXXXXXXXXXXXXXXXX

SEQ ID NO: 817 - protein, 80 aa, Artificial Sequence
  synthetic peptide
  MISC_FEATURE (1)..(20): Xaa may be Gly, Ala, or absent.
  MISC_FEATURE (31)..(31): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIXPPERKYSVWIGGSILASLSTFQQMWIXKQXXXXXXXXXXXXXXXXXXXX

SEQ ID NO: 818 - protein, 80 aa, Artificial Sequence
  synthetic peptide
  MISC_FEATURE (1)..(20): Xaa may be Gly, Ala, or absent.
  MISC_FEATURE (32)..(32): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAXPERKYSVWIGGSILASLSTFQQMWIXKQXXXXXXXXXXXXXXXXXXXX

SEQ ID NO: 819 - protein, 80 aa, Artificial Sequence
  synthetic peptide
  MISC_FEATURE (1)..(20): Xaa may be Gly, Ala, or absent.
  MISC_FEATURE (33)..(33): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPXERKYSVWIGGSILASLSTFQQMWIXKQXXXXXXXXXXXXXXXXXXXX

SEQ ID NO: 820 - protein, 80 aa, Artificial Sequence
  synthetic peptide
  MISC_FEATURE (1)..(20): Xaa may be Gly, Ala, or absent.
  MISC_FEATURE (34)..(34): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPXRKYSVWIGGSILASLSTFQQMWIXKQXXXXXXXXXXXXXXXXXXXX

SEQ ID NO: 821 - protein, 80 aa, Artificial Sequence
  synthetic peptide
  MISC_FEATURE (1)..(20): Xaa may be Gly, Ala, or absent.
  MISC_FEATURE (35)..(35): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPEXKYSVWIGGSILASLSTFQQMWIXKQXXXXXXXXXXXXXXXXXXXX

SEQ ID NO: 822 - protein, 80 aa, Artificial Sequence
  synthetic peptide
  MISC_FEATURE (1)..(20): Xaa may be Gly, Ala, or absent.
  MISC_FEATURE (36)..(36): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERXYSVWIGGSILASLSTFQQMWIXKQXXXXXXXXXXXXXXXXXXXX

SEQ ID NO: 823 - protein, 80 aa, Artificial Sequence
  synthetic peptide
  MISC_FEATURE (1)..(20): Xaa may be Gly, Ala, or absent.
  MISC_FEATURE (37)..(37): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKXSVWIGGSILASLSTFQQMWIXKQXXXXXXXXXXXXXXXXXXXX

SEQ ID NO: 824 - protein, 80 aa, Artificial Sequence
  synthetic peptide
  MISC_FEATURE (1)..(20): Xaa may be Gly, Ala, or absent.
  MISC_FEATURE (38)..(38): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYXVWIGGSILASLSTFQQMWIXKQXXXXXXXXXXXXXXXXXXXX

SEQ ID NO: 825 - protein, 80 aa, Artificial Sequence
  synthetic peptide
  MISC_FEATURE (1)..(20): Xaa may be Gly, Ala, or absent.
  MISC_FEATURE (39)..(39): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSXWIGGSILASLSTFQQMWIXKQXXXXXXXXXXXXXXXXXXXX

SEQ ID NO: 826 - protein, 80 aa, Artificial Sequence
  synthetic peptide
  MISC_FEATURE (1)..(20): Xaa may be Gly, Ala, or absent.
  MISC_FEATURE (40)..(40): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVXIGGSILASLSTFQQMWIXKQXXXXXXXXXXXXXXXXXXXX

SEQ ID NO: 827 - protein, 80 aa, Artificial Sequence
  synthetic peptide
  MISC_FEATURE (1)..(20): Xaa may be Gly, Ala, or absent.
  MISC_FEATURE (41)..(41): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWXGGSILASLSTFQQMWIXKQXXXXXXXXXXXXXXXXXXXX

SEQ ID NO: 828 - protein, 80 aa, Artificial Sequence
  synthetic peptide
  MISC_FEATURE (1)..(20): Xaa may be Gly, Ala, or absent.
  MISC_FEATURE (42)..(42): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIXGSILASLSTFQQMWIXKQXXXXXXXXXXXXXXXXXXXX

SEQ ID NO: 829 - protein, 80 aa, Artificial Sequence
  synthetic peptide
  MISC_FEATURE (1)..(20): Xaa may be Gly, Ala, or absent.
  MISC_FEATURE (43)..(43): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGXSILASLSTFQQMWIXKQXXXXXXXXXXXXXXXXXXXX

SEQ ID NO: 830 - protein, 80 aa, Artificial Sequence
  synthetic peptide
  MISC_FEATURE (1)..(20): Xaa may be Gly, Ala, or absent.
  MISC_FEATURE (44)..(44): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGXILASLSTFQQMWIXKQXXXXXXXXXXXXXXXXXXXX

SEQ ID NO: 831 - protein, 80 aa, Artificial Sequence
  synthetic peptide
  MISC_FEATURE (1)..(20): Xaa may be Gly, Ala, or absent.
  MISC_FEATURE (45)..(45): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSXLASLSTFQQMWIXKQXXXXXXXXXXXXXXXXXXXX

SEQ ID NO: 832 - protein, 80 aa, Artificial Sequence
  synthetic peptide
  MISC_FEATURE (1)..(20): Xaa may be Gly, Ala, or absent.
  MISC_FEATURE (46)..(46): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSIXASLSTFQQMWIXKQXXXXXXXXXXXXXXXXXXXX

SEQ ID NO: 833 - protein, 80 aa, Artificial Sequence
  synthetic peptide
  MISC_FEATURE (1)..(20): Xaa may be Gly, Ala, or absent.
  MISC_FEATURE (47)..(47): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILXSLSTFQQMWIXKQXXXXXXXXXXXXXXXXXXXX

SEQ ID NO: 834 - protein, 80 aa, Artificial Sequence
  synthetic peptide
  MISC_FEATURE (1)..(20): Xaa may be Gly, Ala, or absent.
  MISC_FEATURE (48)..(48): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILAXLSTFQQMWIXKQXXXXXXXXXXXXXXXXXXXX

SEQ ID NO: 835 - protein, 80 aa, Artificial Sequence
  synthetic peptide
  MISC_FEATURE (1)..(20): Xaa may be Gly, Ala, or absent.
  MISC_FEATURE (49)..(49): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASXSTFQQMWIXKQXXXXXXXXXXXXXXXXXXXX

SEQ ID NO: 836 - protein, 80 aa, Artificial Sequence
  synthetic peptide
  MISC_FEATURE (1)..(20): Xaa may be Gly, Ala, or absent.
  MISC_FEATURE (50)..(50): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLXTFQQMWIXKQXXXXXXXXXXXXXXXXXXXX

SEQ ID NO: 837 - protein, 80 aa, Artificial Sequence
  synthetic peptide
  MISC_FEATURE (1)..(20): Xaa may be Gly, Ala, or absent.
  MISC_FEATURE (51)..(51): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSXFQQMWIXKQXXXXXXXXXXXXXXXXXXXX

SEQ ID NO: 838 - protein, 80 aa, Artificial Sequence
  synthetic peptide
  MISC_FEATURE (1)..(20): Xaa may be Gly, Ala, or absent.
  MISC_FEATURE (52)..(52): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTXQQMWIXKQXXXXXXXXXXXXXXXXXXXX

SEQ ID NO: 839 - protein, 80 aa, Artificial Sequence
  synthetic peptide
  MISC_FEATURE (1)..(20): Xaa may be Gly, Ala, or absent.
  MISC_FEATURE (53)..(53): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFXQMWIXKQXXXXXXXXXXXXXXXXXXXX

SEQ ID NO: 840 - protein, 80 aa, Artificial Sequence
  synthetic peptide
  MISC_FEATURE (1)..(20): Xaa may be Gly, Ala, or absent.
  MISC_FEATURE (54)..(54): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQXMWIXKQXXXXXXXXXXXXXXXXXXXX

SEQ ID NO: 841 - protein, 80 aa, Artificial Sequence
  synthetic peptide
  MISC_FEATURE (1)..(20): Xaa may be Gly, Ala, or absent.
  MISC_FEATURE (55)..(55): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQQXWIXKQXXXXXXXXXXXXXXXXXXXX

SEQ ID NO: 842 - protein, 80 aa, Artificial Sequence
  synthetic peptide
  MISC_FEATURE (1)..(20): Xaa may be Gly, Ala, or absent.
  MISC_FEATURE (56)..(56): Xaa may be any natural amino acid or any unnatural amino acid.
  MISC_FEATURE (58)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQQMXIXKQXXXXXXXXXXXXXXXXXXXX

SEQ ID NO: 843 - protein, 80 aa, Artificial Sequence
  synthetic peptide
  MISC_FEATURE (1)..(20): Xaa may be Gly, Ala, or absent.
  MISC_FEATURE (57)..(58): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQQMWXXKQXXXXXXXXXXXXXXXXXXXX

SEQ ID NO: 844 - protein, 80 aa, Artificial Sequence
  synthetic peptide
  MISC_FEATURE (1)..(20): Xaa may be Gly, Ala, or absent.
  MISC_FEATURE (58)..(59): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQQMWIXXQXXXXXXXXXXXXXXXXXXXX

SEQ ID NO: 845 - protein, 80 aa, Artificial Sequence
  synthetic peptide
  MISC_FEATURE (1)..(20): Xaa may be Gly, Ala, or absent.
  MISC_FEATURE (58)..(58): Xaa may be any natural amino acid or any unnatural amino acid.
  MISC_FEATURE (60)..(60): Xaa may be any natural amino acid or any unnatural amino acid.
  MISC_FEATURE (61)..(80): Xaa may be Gly, Ala, or absent.
XXXXXXXXXXXXXXXXXXXXAPSTMKIKIIAPPERKYSVWIGGSILASLSTFQQMWIXKXXXXXXXXXXXXXXXXXXXXX

SEQ ID NO: 846 - protein, 377 aa, Homo sapien
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 847 - protein, 377 aa, Homo sapien
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 848 - protein, 375 aa, Homo sapien
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 849 - protein, 350 aa, Homo sapien
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLS

SEQ ID NO: 850 - protein, 350 aa, Mus musculus
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLS

SEQ ID NO: 851 - protein, 350 aa, Oryctolagus cuniculus
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEERPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLS

SEQ ID NO: 852 - protein, 351 aa, Drosophila melanogaster
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMEACGIHETTYNSIMKCDVDIRKDLYANTVLSGGTTMYPGIADRMQKEITALAPSTMKIKIIAPPERKYSVWIGGSILASLS

SEQ ID NO: 853 - protein, 10 aa, Homo sapien
YNELRVAPEE

SEQ ID NO: 854 - protein, 10 aa, Homo sapien
QIMFETFNTP

SEQ ID NO: 855 - protein, 10 aa, Homo sapien
LPHAILRLDL

SEQ ID NO: 856 - protein, 10 aa, Homo sapien
AGRDLTDYLM

SEQ ID NO: 857 - protein, 10 aa, Homo sapien
LCYVALDFEQ

SEQ ID NO: 858 - protein, 10 aa, Homo sapien
KYSVWIGGSI

What is claimed is:

1. An actin-based peptide, comprising
an actin core domain and a cell penetration domain, operably linked together by a spacer domain,
wherein an N-terminus or C-terminus may have either the actin core domain or the cell penetration domain; and
wherein the actin core domain is a B11 core domain having the sequence of YVALDFE, which are the amino acid residues 3-9 of SEQ ID NO:857.

2. The actin-based peptide of claim 1, wherein the actin core domain functions to control viral or bacterial infection of a cell by inhibiting or enhancing viral or bacterial infection or bacterial vector delivery into the cell.

3. The actin-based peptide of claim 1, wherein the actin core domain is labeled with a traceable dye or marker.

4. The actin-based peptide of claim 1, wherein said cell penetration domain is a cell penetration peptide.

5. An actin-based peptide of claim 1, wherein said actin core domain modulates a cellular bioactivity selected from the group consisting of cytoplasmic and nuclear actin dynamics; cell morphology; cell motility and mobility; cell surface receptor density; cell adhesion processes; gene expression; cell division, growth, differentiation, and apoptosis; the processes of endocytosis and exocytosis; smooth and heart muscle cell contraction and relaxation, blood vessel elasticity and capacitance; a process of inflammation; cellular susceptibility to intracellular pathogens, or cellular uptake of chemical compounds, including small and macro molecules, medical drugs, nucleic acids, and proteins.

6. The actin-based peptide of claim 5, wherein said actin-based peptide is labeled with a traceable dye or marker.

7. The actin-based peptide of claim 1, wherein the actin-based peptide comprises the amino acid sequence of SEQ ID NOs: 5, 13, 602-604, 627-630, 649-661, 666-672, 680-701, or 709-723.

8. The actin-based peptide of claim 1, wherein the actin-based peptide is selected from the group consisting of SEQ ID NO: 5 and SEQ ID NO: 13.

9. The actin-based peptide of claim 1, wherein the actin-based peptide comprises the amino acid sequence of SEQ ID NOs: 602-604 or 627-630.

10. The actin-based peptide of claim 1, wherein the actin-based peptide comprises the amino acid sequence of SEQ ID NOs: 649-661.

11. The actin-based peptide of claim 1, wherein the actin-based peptide comprises the amino acid sequence of SEQ ID NOs: 666-672, 680-701, or 709-723.

12. A kit comprising one or more actin-based peptides of claim 1 and an effective amount of a therapeutic compound, a diagnostic compound, or a compound for modulating cellular activity.

13. A method for controlling viral or bacterial infection, comprising administering an actin-based peptide of claim 1 to a cell, virus, or bacteria, in an amount sufficient to inhibit or enhance infection of said virus or bacteria.

14. The method of claim 13, wherein HIV infection is increased by administering said actin-based peptide to a cell.

15. A method for modulating cellular bioactivity, comprising delivering into a cell one or more actin-based peptides of claim 1 in an amount effective to modulate cellular bioactivity.

* * * * *